US008530181B2

(12) United States Patent
Inoue (10) Patent No.: US 8,530,181 B2
(45) Date of Patent: Sep. 10, 2013

(54) METHOD OF SCREENING FOR COMPOUNDS WHICH AFFECT THE CLEAVAGE OF EPHA7 BY γ-SECRETASE

(75) Inventor: Eiji Inoue, Kobe (JP)

(73) Assignee: Eisai R&D Management Co., Ltd., Tokyo (JP)

(*) Notice: Subject to any disclaimer, the term of this patent is extended or adjusted under 35 U.S.C. 154(b) by 284 days.

(21) Appl. No.: 12/742,312

(22) PCT Filed: Nov. 17, 2008

(86) PCT No.: PCT/JP2008/070864
§ 371 (c)(1),
(2), (4) Date: May 20, 2010

(87) PCT Pub. No.: WO2009/064006
PCT Pub. Date: May 22, 2009

(65) Prior Publication Data
US 2010/0255522 A1 Oct. 7, 2010

Related U.S. Application Data

(60) Provisional application No. 60/988,203, filed on Nov. 15, 2007.

(51) Int. Cl.
*C12Q 1/37* (2006.01)

(52) U.S. Cl.
USPC .......................................................... 435/23

(58) Field of Classification Search
USPC .......................................................... 435/23
See application file for complete search history.

(56) References Cited

U.S. PATENT DOCUMENTS

| | | | |
|---|---|---|---|
| 5,876,946 A | 3/1999 | Burbaum et al. | |
| 5,902,732 A | 5/1999 | Hochman | |
| 7,892,769 B2* | 2/2011 | Inoue et al. | 435/7.21 |
| 7,910,324 B2* | 3/2011 | Inoue | 435/23 |
| 8,137,926 B2* | 3/2012 | Inoue | 435/23 |
| 2002/0068361 A1 | 6/2002 | Clary | |
| 2006/0241074 A1 | 10/2006 | Woolf et al. | |
| 2007/0015145 A1 | 1/2007 | Woolf et al. | |
| 2007/0026409 A1 | 2/2007 | Woolf et al. | |
| 2008/0213250 A1* | 9/2008 | Hopf et al. | 424/130.1 |
| 2009/0023158 A1 | 1/2009 | Shapiro et al. | |
| 2009/0142788 A1 | 6/2009 | Inoue | |
| 2009/0163594 A1 | 6/2009 | Shapiro et al. | |
| 2009/0191580 A1 | 7/2009 | Inoue | |
| 2009/0275049 A1 | 11/2009 | Inoue et al. | |
| 2010/0021950 A1 | 1/2010 | Lammert et al. | |
| 2010/0113415 A1* | 5/2010 | Rajapakse et al. | 514/210.21 |
| 2010/0190184 A1 | 7/2010 | Inoue | |
| 2010/0255522 A1 | 10/2010 | Inoue | |
| 2011/0104171 A1 | 5/2011 | Inoue | |
| 2011/0111444 A1 | 5/2011 | Inoue | |

FOREIGN PATENT DOCUMENTS

| | | |
|---|---|---|
| EP | 0351585 A2 | 1/1990 |
| EP | 1 514 925 A1 | 3/2005 |
| EP | 1 662 259 A1 | 5/2006 |
| EP | 1662259 * | 5/2006 |
| EP | 1 693 449 A1 | 8/2006 |
| EP | 1 947 193 A1 | 7/2008 |
| EP | 1 815 255 B1 | 4/2009 |
| EP | 2 166 110 A1 | 3/2010 |
| JP | 2824433 B2 | 11/1998 |
| JP | 2824433 B2 | 11/1998 |
| JP | 2003-169699 | 6/2003 |
| JP | 3680114 | 8/2005 |
| JP | 2006-508653 | 3/2006 |
| WO | WO 98/45708 | 10/1998 |
| WO | WO 03/016475 A2 | 2/2003 |
| WO | WO 2004/048578 A1 | 6/2004 |
| WO | WO 2005/045028 A1 | 5/2005 |
| WO | WO 2005/083086 A2 | 9/2005 |
| WO | WO-2006/026820 A1 | 3/2006 |
| WO | WO 2006/056467 A1 | 6/2006 |
| WO | WO 2006/061660 A1 | 6/2006 |
| WO | WO 2008/087035 A2 | 7/2008 |
| WO | WO 2008/150010 A1 | 12/2008 |

OTHER PUBLICATIONS

Carter, Chris. Alzheimer's Disease: . . . International J of Alzheimer's Disease vol. 2011, pp. 1-34, 2011.*
Haapasalo et al., "Presenilin/γ-Secretase-Mediated Cleavage Regulates Association of Leukocyte-Common Antigen-Related (LAR) Receptor Tyrosine Phosphatase with β-Catenin," J. Biol. Chem. 282:9063-9072, 2007.
Litterst et al., "Ligand Binding and Calcium Influx Induce Distinct Ectodomain/γ-Secretase-Processing Pathways of EphB2 Receptor," J. Biol. Chem. 282:16155-16163, 2007.
Maretzky et al., "L1 is Sequentially Processed by Two Differently Activated Metalloproteases and Presenilin/γ-Secretase and Regulates Neural Cell Adhesion, Cell Migration, and Neurite Outgrowth," Mol. Cell. Biol. 25:9040-9053, 2005.
Extended European Search Report from European Patent Application No. 08849729.2, dated Nov. 26, 2010.
Foveau et al., "Down-Regulation of the Met Receptor Tyrosine Kinase by Presenilin-Dependent Regulated Intramembrane Proteolysis," Mol. Biol. Cell 20:2495-2507, 2009.
Landman and Kim, "Got RIP? Presenilin-Dependent Intramembrane Proteolysis in Growth Factor Receptor Signaling," Cytokine & Growth Factors Rev. 15:337-351, 2004.

(Continued)

*Primary Examiner* — Ralph Gitomer
(74) *Attorney, Agent, or Firm* — Clark & Elbing LLP (57) ABSTRACT

The present invention provides a method of screening for compounds which affect the cleavage of EphA7 by γ-secretase. The method includes the following steps:
(i) contacting a first biological composition containing γ-secretase or a biologically active fragment thereof with a second biological composition containing EphA7 in the presence and absence of a candidate compound;
(ii) measuring the cleavage of the EphA7 in the presence and absence of the candidate compound;
(iii) selecting those candidate compounds which affect the cleavage of the EphA7 by γ-secretase; and
(iv) identifying the candidate compounds selected in step (iii) as compounds which affect the cleavage of EphA7 by γ-secretase.

7 Claims, 1 Drawing Sheet

(56) References Cited

OTHER PUBLICATIONS

Lee et al., "Presenilin-Dependent γ-Secretase-Like Intramembrane Cleavage of ErbB4," J. Biol. Chem. 277:6318-6323, 2002.
Pozner-Moulis et al., "Met, the Hepatocyte Growth Factor Receptor, Localizes to the Nucleus in Cells at Low Density," Cancer Res. 66:7976-7982, 2006.
Supplementary European Search Report from European Patent Application No. 08791346.3, dated Nov. 29, 2010.
Wajih et al., "Vascular Origin of a Soluble Truncated Form of the Hepatocyte Growth Factor Receptor (c-met)," Circ. Res. 90:46-52, 2002.
Xu et al., "Expression of Truncated *Sek-1* Receptor Tyrosine Kinase Disrupts the Segmental Restriction of Gene Expression in the *Xenopus* and Zebrafish Hindbrain," Development 121:4005-4016, 1995.
Supplemental European Search Report from European Patent Application No. 08853626, dated Mar. 18, 2011 (date of completion of search) and Apr. 4, 2011 (date of mailing of report).
International Search Report from International Application No. PCT/JP2008/060567, dated Aug. 13, 2008 (date of completion of search) and Aug. 26, 2008 (date of mailing of report).
International Search Report from International Application No. PCT/JP2008/063037, dated Sep. 2, 2008 (date of completion of search) and Sep. 9, 2008 (date of mailing of report).
International Search Report from International Application No. PCT/JP2008/071831, dated Jan. 14, 2009 (date of completion of search) and Jan. 27, 2009 (date of mailing of report).
International Search Report from International Application No. PCT/JP2008/063901, dated Aug. 18, 2008 (date of completion of search) and Aug. 26, 2008 (date of mailing of report).
Restriction Requirement from U.S. Appl. No. 12/135,307, dated Mar. 19, 2010.
Reply to Restriction Requirement from U.S. Appl. No. 12/135,307 dated Mar. 19, 2010, filed May 6, 2010.
Reply to Office Action from U.S. Appl. No. 12/135,307 dated Jun. 10, 2010, filed Sep. 2, 2010.
Reply to Office Action from U.S. Appl. No. 12/175,595 dated May 17, 2011, filed Aug. 18, 2011.
Reply to Final Office Action from U.S. Appl. No. 12/175,595 dated Nov. 8, 2011, filed Feb. 8, 2012.
Office Action from U.S. Appl. No. 12/175,595 dated Apr. 18, 2012.
Restriction Requirement from U.S. Appl. No. 12/325,418, dated Nov. 10, 2009.
Response to Restriction Requirement from U.S. Appl. No. 12/325,418 dated Nov. 10, 2009, filed Dec. 10, 2009.
Reply to Office Action from U.S. Appl. No. 12/325,418 dated Apr. 1, 2010, filed Jul. 21, 2010.
Reply to Office Action from U.S. Appl. No. 13/009,127 dated Jul. 13, 2011, filed Sep. 28, 2011.
Office Action from U.S. Appl. No. 12/670,987 dated Apr. 5, 2012.
Response to Examination Report from European Patent Application No. 08853626.3 dated Nov. 18, 2011, filed Mar. 14, 2012.
McLendon et al., "Cell-Free Assays for γ-Secretase Activity," FASEB J. 14:2383-2386, 2000.
Communication Under Rule 71(3) EPC from European Patent Application No. 08849729.2, dated Apr. 26, 2012.
Akimoto et al., "Hepatocyte Growth Factor as an Enhancer of NMDA Currents and Synaptic Plasticity in the Hippocampus," Neurosci. 128:155-162, 2004.
Amtul et al., "A Presenilin 1 Mutation Associated with Familial Frontotemporal Dementia Inhibits γ-Secretase Cleavage of APP and Notch," Neurobiol. Dis. 9:269-273, 2002.
Aoto et al., "Bidirectional Ephrin/Eph Signaling in Synaptic Functions," Brain Res. 1184:72-80, 2007.
Cheng et al., "γ-Secretase Activity is Dispensable for Mesenchyme-to-Epithelium Transition but Required for Podocyte and Proximal Tubule Formation in Developing Mouse Kidney," Development 130:5031-5042, 2003.

Fox et al., "cDNA Cloning and Tissue Distribution of Five Human EPH-Like Receptor Protein-Tyrosine Kinases," Oncogene 10:897-905, 1995.
Hansson et al., "Nicastrin, Presenilin, APH-1, and PEN-2 Form Active γ-Secretase Complexes in Mitochondria," J. Biol. Chem. 279:51654-51660, 2004.
Inoue et al., "Synaptic Activity Prompts γ-Secretase-Mediated Cleavage of EphA4 and Dendritic Spine Formation," J. Cell Biol. 185:551-564, 2009.
Kopan et al., "γ-Secretase: Proteasome of the Membrane?" Mol. Cell Biol. 5:499-504, 2004.
Kuure et al., "Crosstalk Between Jagged1 and GDNF/Ret/GFRα1 Signalling Regulates Ureteric Budding and Branching," Mech. Dev. 122:765-780, 2005.
Liu et al., "Intramembrane Proteolysis of Human NotchdeltaE.," Society for Neuroscience Abstract Viewer and Itinerary Planner, BIOSIS 2003:729.11, 2003.
Minopoli et al., "Receptor- and Non-Receptor Tyrosine Kinases Induce Processing of the Amyloid Precursor Protein: Role of the Low-Density Lipoprotein Receptor-Related Protein," Neurodegenerative Dis. 4:94-100, 2007.
Murai et al., "Control of Hippocampal Dendritic Spine Morphology Through Ephrin-A3/EPHA4 Signaling," Nature Neurosci. 6:153-160, 2003.
Nath et al., "Shedding of c-Met is Regulated by Crosstalk Between a G-Protein Coupled Receptor and the EGF Receptor and is Mediated by a TIMP-3 Sensitive Metalloproteinase," J. Cell Sci. 114:1213-1220, 2001.
Pelletier et al., "γ-Secretase-Dependent Proteolysis of CD44 Promotes Neoplastic Transformation of Rat Fibroblastic Cells," Cancer Res. 66:3681-3687, 2006.
Penzes et al., "Convergent CaMK and RacGEF Signals Control Dendritic Structure and Function," Trends Cell Biol. 18:405-413, 2008.
Ramakers "Rho Proteins, Mental Retardation and the Cellular Basis of Cognition," TRENDS Neurosci. 25:191-199, 2002.
Sarlola et al., "Novel Functions and Signalling Pathways for GDNF," J. Cell. Sci. 116:3855-3862, 2003.
Sastre et al., "Presenilin-Dependent γ-Secretase Processing of β-Amyloid Precursor Protein at a Site Corresponding to the S3 Cleavage of Notch," EMBO Reports 2:835-841, 2001.
Shamah et al., "EphA Receptors Regulate Growth Cone Dynamics Through the Novel Guanine Nucleotide Exchange Factor Ephexin," 105:233-244, 2001.
Tashiro et al., "Regulation of Dendritic Spine Motility and Stability by Rac1 and Rho Kinase: Evidence for Two Forms of Spine Motility," Mol. Cell Neurosci. 26:429-440, 2004.
Tomita et al., "Presenilin-Dependent Intramembrace Cleavage of Ephrin-BI," Mol. Neurodegen. 1:1-9, 2006.
Tyndall et al., "The Receptor Tyrosine Kinase Met and its Ligand Hepatocyte Growth Factor are Clustered at Excitatory Synapses and can Enhance Clustering of Synaptic Proteins," Cell Cycle 5:1560-1568, 2006.
Vidal et al., "Presenilin-Dependent γ-Secretase Processing Regulates Multiple ERBB4/HER4 Activities," J. Biol. Chem. 280:19777-19783, 2005.
Yokote et al., "Trans-Activation of EphA4 and FGF Receptors Mediated by Direct Interactions Between Their Cytoplasmic Domains," Proc. Natl. Acad. Sci. U.S.A. 102:18866-18871, 2005.
Zhao et al., "Role of p21-Activated Kinase Pathway Defects in the Cognitive Deficits of Alzheimer Disease," Nature Neurosci. 9:234-242, 2006.
Zou et al., "Linking Receptor-Mediated Endocytosis and Cell Signaling," J. Biol. Chem. 279:34302-34310, 2004.
Extended European Search Report from European Patent Application No. 08765357.2, dated Jun. 25, 2010.
Saura et al., "Loss of Presenilin Function Causes Impairments of Memory and Synaptic Plasticity Followed by Age-Dependent Neurodegeneration," Neuron 42:23-36, 2004.
Yamaguchi et al., "Eph Receptors in the Adult Brain," Curr. Opin. Neurobiol. 14:288-296, 2004.

Fraering et al., "γ-Secretase Substrate Selectivity can be Modulated Directly via Interaction with a Nucleotide-Binding Site," J. Biol. Chem. 280:41987-41996, 2005.
Kaether et al., "Assembly, Trafficking and Function of Gamma-Secretase," Neurodegener. Dis. 3(4-5):275-283, 2006. (Abstract).
Ra et al., "Control of Matrix Metalloproteinase Catalytic Activity," Matrix Biol. 26(8):587-596, 2007.
Wikipedia, the free encyclopedia, Gamma Secretase, Jan. 16, 2012.
Communication Pursuant to Article 94(3) EPC, from European Patent Application No. 08 853 626.3, dated Nov. 18, 2011.
Office action from U.S. Appl. No. 12/135,307 dated Jun. 10, 2010.
Office Action from U.S. Appl. No. 12/175,595 dated May 17, 2011.
Office Action from U.S. Appl. No. 12/175,595 dated Nov. 8, 2011.
Office action from U.S. Appl. No. 12/325,418 dated Apr. 1, 2010.
Office Action from U.S. Appl. No. 13/009,127, dated Jul. 13, 2011.
Murphy et al., "γ-Secretase, Evidence for Multiple Proteolytic Activities and Influence of Membrane Positioning of Substrate on Generation of Amyloid β Peptides of Varying Length," J. Biol. Chem. 17:11914-11923, 1999.
Georgakopoulos et al., "Metalloproteinase/Presenilin1 Processing of EphrinB Regulates EphB-Induced Src Phosphorylation and Signaling," EMBO J. 25:1242-1252, 2006.
Holmberg et al., "Regulation of Repulsion Versus Adhesion by Different Splice Forms of an Eph Receptor," Nature 408:203-206, 2000.
Nakanishi et al., "ALL1 Fusion Proteins Induce Deregulation of EphA7 and ERK Phosphorylation in Human Acute Leukemias," Proc. Natl. Acad. Sci. U.S.A. 104:14442-14447, 2007.
International Search Report from International Application No. PCT/JP2008/070864, dated Dec. 16, 2008 (date of completion of search) and Jan. 6, 2009 (date of mailing of report).
Aoto and Chen, "Bidirectional ephrin/Eph signaling in synaptic functions," Brain Research 1184: 72-80, 2007.
Braak and Braak, "Neuropathological Stageing of Alzheimer-Related Changes," Acta Neuropathol. 82: 239-259, 1991.
Eriksen et al., "NSAIDS and Enantiomers of Flurbiprofen Target γ-Secretase and Lower Aβ42 in Vivo," J. Clinical Investigation 112(3): 440-449, 2003.
Folstein et al., "Mini-Mental State' A Practice Method for Grading the Cognitive State of Patients for the Clinician," J. Psychiat. Res. 12: 189-198, 1975.
Gahwiler, "Organotypic Cultures of Neural Tissue," TINS 11(11): 484-489, 1988.
Galasko et al., "An Inventory to Assess Activities of Daily Living for Clinical Trials in Alzheimer's Disease," Alzheimer Disease and Associated Disorders 11: S33-S39, 1997.
Hansson et al., "Nicastrin, Presenilin, APH-1, and PEN-2 Form Active γ-Secretase Complexes in Mitochondria," Bio. Chem. 279(49): 51654-51660, 2004.
Hering et al., "Dendritic Spines: Structure, Dynamics and Regulation," Nature 2: 880-888, 2001.
Houston and Banks, "The Chemical-Biological Interface: Developments in Automated and Miniaturised Screening Technology," Biotechnology 8: 734-740, 1997.
Jayawickreme and Kost, "Gene Expression Systems in the Development of High-Throughput Screens," Biotechnology 8: 629-634, 1997.
Kawarabayashi et al., "Age-Dependent Changes in Brain, CSF, and Plasma Amyloid β Protein in the Tg2576 Transgenic Mouse Model of Alzheimer's Disease," Neuroscience 21(2): 372381, 2001.
Khachaturian, "Diagnosis of Alzheimer's Disease," Arch Neurol. 42: 1097-1105, 1985.
Köhler and Milstein, "Continuous Cultures of Fused Cells Secreting Antibody of Predefined Specificity," Nature 256: 495-497, 1975.
Lanz et al., "The γ-Secretase Inhibitor N-[N-(3,5-Difluorophenacety1)-L-alanyl]-S-phenylglycine t-butyl Ester Reduces Aβ Levels in Vivo in Plasma and Cerebrospinal Fluid in Young (Plaque-Fee) and Aged (Plaque-Bearing) Tg2576 Mice," JPET 305: 864-871, 2003.
Maulik et al., "Role of the Hepatocyte Growth Factor Receptor, c-Met, in Oncogenesis and Potential for Therapeutic Inhibition," Cytokine & Growth Factor Reviews 13: 41-59, 2002.
McKhann et al., "Clinical Diagnosis of Alzheimer's Disease: Report of the NINCDS-ADRDA Work Group Under the Auspices of Department of Health and Human Services Task Force on Alzheimer's Disease," Neurology 34: 939-944, 1984.
Mirra et al., "Making the Diagnosis of Alzheimer's Disease," Arch Pathol Lab Med 117: 132-144, 1993.
Mirra et al., "The Consortium to Establish a Registry for Alzheimer's Disease (CERAD). Part II. Standardization of the Neuropathologic Assessment of Alzheimer's Disease," Neurology 41: 479-486, 1991.
Moehlmann et al., "Presenilin-1 Mutations of Leucine 166 Equally Affect the Generation of the Notch and APP Intracellular Domains Independent of their Effect on Aβ42 Production," PNAS 99(12): 8025-8030, 2002.
Mohs, "The Alzheimer's Disease Assessment Scale," International Psychogeriatrics 8(2): 195-203, 1996.
Niwa et al., "Efficient Selection for High-Expression Transfectants with a Novel Eukaryotic Vector," Gene 108: 193-200, 1991.
Pak et al., "Regulation of Dendritic Spine Morphology by SPAR, a PSD-95-Associated RapGAP," Neuron 31: 289-303, 2001.
Sakaguchi et al., "Sprouting of CA3 Pyramidal Neurons to the Dentate Gyrus in Rat Hippocampal Organotypic Cultures," Neuroscience Research 20: 157-164, 1994.
Sambrook et al., "Introduction of Recombinant Vectors into Mammalian Cells," Molecular Cloning, A Laboratory Manual, Cold Spring Harbor Laboratory Press: Cold Spring Harbor, NY, 1989, 16.30-16.31.
Song et al., "Proteolytic Release and Nuclear Translocation of Notch-1 are Induced by Presenilin-1 and Impaired by Pathogenic Presenilin-1 Mutations," Proc. Natl. Acad. Sci. USA 96: 6959-6963, 1999.
Stoppini et al., "A Simple Method for Organotypic Cultures of Nervous Tissue," Journal of Neuroscience Methods 37: 173-182, 1991.
Tremblay et al., "Localization of EphA4 in Axon Terminals and Dendritic Spines of Adult Rat Hippocampus," The Journal of Comparative Neurology 501: 691-702, 2007.
Reply to Restriction Requirement for U.S. Appl. No. 12/986,922, dated Feb. 4, 2013 (1 page).
Beg et al., "α2-Chimaerin Is an Essential EphA4 Effector in the Assembly of Neuronal Locomotor Circuits," Neuron 55: 768-778 (2007).
Dufour et al., "Genetic analysis of EphA-dependent signaling mechanisms controlling topographic mapping in vivo," Development 133: 4415-4420 (2006).
Invitrogen product sheet for Mouse anti-EphA4 Receptor monoclonal antibody, clone 4C8H5, downloaded from website on Apr. 5, 2013 (2 pages).
Martone et al., "Immunolocalization of the receptor tyrosine kinase EphA4 in the adult rat central nervous system," Brain Research 771: 238-250 (1997).
Yang et al., "Preparation and Analysis of Monoclonal Antibody Against EphA4 Peptide," J. Cent. South Univ. (Med Sci) 30(5): 529-532 (2005). Certified English translation of the original Chinese article.
Office Action for U.S. Appl. No. 12/986,922 dated Apr. 10, 2013 (46 pages).
Carter, "Alzheimer's Disease: APP, Gamma Secretase, APOE, CLU, CR1, PICALM, ABCA7, BIN1, CD2AP, CD33, EPHA1, and MS4A2, and Their Relationships with Herpes Simplex, C. Pneumoniae, Other Suspect Pathogens, and the Immune System," International Journal of Alzheimer's Disease 2011: 1-34, 2011.
GenBank, NCBI Reference Sequence: XM_244186.3, PREDICTED: Rattus Norvegicus Similar to Eph Receptor A4 (LOC316539), mRNA, dated Feb. 21, 2012.
Extended European Search Report for European Patent Application No. 08792114.4, dated Nov. 9, 2010 (6 pages).
Reply to Communication for European Patent Application No. 08765357.2, dated Jul. 13, 2010, filed Jan. 7, 2011 (6 pages).
Communication for European Patent Application No. 08765357.2, dated Feb. 4, 2011 (4 pages).
Reply to Communication for European Patent Application No. 08792114.4, dated Nov. 26, 2010, filed May 26, 2011 (4 pages).
Reply to Communication for European Patent Application No. 08765357.2, dated Feb. 4, 2011, filed Jun. 1, 2011 (4 pages).
Reply to Communication for European Patent Application No. 08849729.2, dated Dec. 14, 2010, filed Jun. 21, 2011 (6 pages).

Reply to Communication for European Patent Application No. 08791346.3, dated Dec. 16, 2010, filed Jun. 21, 2011 (4 pages).
Reply to Communication for European Patent Application No. 08853626.3, dated Apr. 21, 2011, filed Oct. 21, 2011 (15 pages).
Office Action for Japanese Patent Application No. 2009-543902, dated Feb. 21, 2012 (8 pages) (English Language translation provided).
Reply to Communication for European Patent Application No. 08853626.3, dated Nov. 18, 2011, filed Mar. 14, 2012 (9 pages).
Result of Consultation by Telephone with the Applicant for European Patent Application No. 08849729.2, dated Mar. 20, 2012 (3 pages).
Reply to Office Action for Japanese Patent Application No. 2009-543902, dated Apr. 27, 2012 (25 pages) (English Language translation provided).
Communication for European Patent Application No. 08853626.3, dated Oct. 29, 2012 (4 pages).
Office Action for Japanese Patent Application No. 2009-543902, dated Oct. 31, 2012 (10 pages) (English Language translation provided).
Reply to Communication for European Patent Application No. 08853626.3, dated Oct. 29, 2012, filed Dec. 27, 2012 (46 pages).
Reply to Office Action for Japanese Patent Application No. 2009-543902, dated Nov. 6, 2012, filed Dec. 28, 2012 (33 pages) (English Language translation provided).
Restriction Requirement for U.S. Appl. No. 12/986,922, dated Jan. 18, 2013 (7 pages).

* cited by examiner

Fig. 1

METHOD OF SCREENING FOR COMPOUNDS WHICH AFFECT THE CLEAVAGE OF EPHA7 BY γ-SECRETASE

CROSS-REFERENCE TO RELATED APPLICATIONS

This application is a national stage application filed under Rule 371 based on PCT/JP2008/070864 filed Nov. 17, 2008 which claims benefit to 60/988,203 filed Nov. 15, 2007.

TECHNICAL FIELD

The present invention relates to a screening method using EphA7, which is a novel substrate for γ-secretase, and a kit for use in the method.

BACKGROUND ART

γ-Secretase is a complex protein (aspartate protease) comprising presenilin, nicastrin, Aph-1 and Pen-2 as basic components. Presenilin is the catalytic domain; presenilin gene has been identified as a causative gene for familial Alzheimer's disease (AD). γ-Secretase acts on single-pass transmembrane proteins as its substrates. As most representative substrates thereof, amyloid precursor protein (APP) and Notch are known. When cleaved by β-secretase at β-site and by γ-secretase at γ-site, APP produces amyloid β protein (Aβ). The thus-produced Aβ is classified into peptides with different lengths depending on the cleavage site in the amino acid sequence (C-terminal side). Of these peptides, Aβ42 which is strongly hydrophobic and ready to aggregate (ready to take the β-sheet structure) exhibits neurotoxicity. It has been considered that this phenomenon may be the major cause of Alzheimer's disease. Recently, however, a report has been made that presenilin 1 (PS1) and presenilin 2 (PS2) double-knockout mice capable of producing no Aβ show AD-like phenotypes such as decrease of synapses and neuronal death; this suggests existence of a pathogenic mechanism of AD independent from APP (Non-Patent Document No. 1).

On the other hand, Eph receptor A7 (EphA7) is a member of the receptor tyrosine kinase family, and EphA family is a group of molecules which regulate the formation and maintenance of synapses (Non-Patent Document No. 2). Therefore, it is believed highly possible that EphA7 is also involved in the formation and maintenance of synapses.

However, it has never been reported to date that EphA7 is a substrate for γ-secretase.

[Non-Patent Document No. 1] Saura C A, Choi S Y, Beglopoulos V, Malkani S, Zhang D, Shankaranarayana Rao B S, Chattarji S, Kelleher R J 3rd, Kandel E R, Duff K, Kirkwood A, and Shen J., Loss of presenilin function causes impairments of memory and synaptic plasticity followed by age-dependent neurodegeneration, Neuron. 2004 Apr. 8; 42(1):23-36.

[Non-Patent Document No. 2] Yamaguchi Y, Pasquale E B. Eph receptors in the adult brain. Curr Opin Neurobiol. 2004 June; 14(3):288-96.

DISCLOSURE OF THE INVENTION

Problem for Solution by the Invention

It is an object of the present invention to provide a screening method using EphA7, a novel substrate for γ-secretase, in particular a method of screening for compounds which affect the processing of EphA7 by γ-secretase.

Means to Solve the Problem

The present inventors have proved for the first time that EphA7 is cleaved by γ-secretase in HEK293 cells and primary culture of hippocampal neurons, by using a γ-secretase inhibitor (2S)-2-{[(3,5-difluorophenyl)acetyl]amino}-N-[(3S)-1-methyl-2-oxo-5-phenyl-2,3-dihydro-1H-1,4-benzodiazepin-3-yl]propanamide. The present inventors have also found for the first time that it is possible to detect the cleavage of EphA7 by using an antibody specific to cleaved EphA7 or an antibody specific to a hemagglutinin tag at the C-terminus of EphA7.

Briefly, by showing that the cleavage of EphA7 is inhibited by γ-secretase inhibitor, the present inventors have demonstrated that a screening method with EphA7 utilizing the EphA7 degradation activity of γ-secretase (in particular, cleavage accelerating activity or cleavage inhibiting activity) is effective.

An accelerator for the EphA7 degradation activity of γ-secretase obtainable by the screening method of the present invention is a compound which accelerates the processing of EphA7 through γ-secretase. An inhibitor for the EphA7 degradation activity of γ-secretase obtainable by the screening method of the present invention is a compound Which reduces the processing of EphA7 through γ-secretase. According to the present invention, it has become possible to develop therapeutics for memory disorders of interest, especially dementia (preferably AD), by selecting those compounds which act on γ-secretase selectively.

The present invention provides the following embodiments.

In one embodiment, the present invention relates to a method of screening for compounds which affect the processing of EphA7 by γ-secretase. More specifically, the method comprises the following steps: (a) an assay step of examining the cleavage of EphA7 by γ-secretase, wherein a first biological composition containing γ-secretase or a biologically active fragment thereof is contacted with a second biological composition containing EphA7 to thereby measure the cleavage of the EphA7; and (b) a step of secondarily evaluating whether or not candidate compounds affect γ-secretase, wherein those candidate compounds which affect the cleavage of the EphA7 by γ-secretase are selected and the thus selected compounds are identified as compounds which affect the processing of EphA7 by γ-secretase.

In another embodiment, the present invention relates to a screening method further comprising, in addition to the above-described steps, a step of evaluating a candidate compound as a compound which inhibits the processing of EphA7 through γ-secretase or an inhibitor for the EphA7 degradation activity of γ-secretase, when EphA7 undegraded product in the presence of the candidate compound was increased relative to EphA7 undegraded product in the absence of the candidate compound.

In still another embodiment, the present invention relates to a screening method further comprising, in addition to the above-described steps, a step of evaluating a candidate compound as a compound which accelerates the processing of EphA7 through γ-secretase or an accelerator for the EphA7 degradation activity of γ-secretase, when EphA7 undegraded product in the presence of the candidate compound was decreased relative to EphA7 undegraded product in the absence of the candidate compound.

In still another embodiment, the present invention relates to a screening method further comprising, in addition to the above-described steps, a step of evaluating a candidate compound as a compound which accelerates the processing of EphA7 through γ-secretase or an accelerator for the EphA7 degradation activity of γ-secretase, when EphA7 cleavage product in the presence of the candidate compound was increased relative to EphA7 cleavage product in the absence of the candidate compound.

In still another embodiment, the present invention relates to a screening method further comprising, in addition to the above-described steps, a step of evaluating a candidate compound as a compound which inhibits the processing of EphA7 through γ-secretase or an inhibitor for the EphA7 degradation activity of γ-secretase, when EphA7 cleavage product in the presence of the candidate compound was decreased relative to EphA7 cleavage product in the absence of the candidate compound.

In still another embodiment, the present invention relates to a screening method further comprising, in addition to the above-described method, a step of measuring the cleavage of APP or a polypeptide comprising a γ-secretase cleavage site of APP (hereinafter, expressed as "polypeptide comprising an APP γ-secretase cleavage site").

In still another embodiment, the present invention relates to a screening method further comprising, in addition to the above-described method, a step of measuring the cleavage of Notch or a polypeptide comprising a γ-secretase cleavage site of Notch (hereinafter, expressed as "polypeptide comprising a Notch γ-secretase cleavage site").

In still another embodiment, the present invention provides a pharmaceutical composition comprising at least one compound identified by the screening method of the present invention and a pharmacologically acceptable carrier. Preferably, the above compound is (2S)-2-{[(3,5-difluorophenyl)acetyl]amino}-N-[(3S)-1-methyl-2-oxo-5-phenyl-2,3-dihydro-1H-1,4-benzodiazepin-3-yl]propanamide (hereinafter, sometimes referred to as "Compound E").

In still another embodiment, the present invention provides a method of treating a disease or condition in which the processing of EphA7 by γ-secretase is abnormal, comprising a step of administering to a patient in need of treatment, preferably a patient with a condition of dementia (preferably AD), an effective dose of the compound of the present invention or a pharmaceutical composition comprising the same (preferably a therapeutic for dementia), wherein preferably the dose is effective for altering the EphA7 processing activity of γ-secretase in the cells of the patient.

In still another embodiment, the present invention provides, in addition to the above-described kit, a kit for γ-secretase assay or a screening kit for identifying inhibitors or accelerators for γ-secretase, each comprising EphA7 and preferably further comprising a substrate for γ-secretase other than EphA7 (preferably APP and/or Notch), or a screening kit for identifying. Each of these kits is applicable to the method of the present invention.

In still another embodiment, the present invention provides a test kit for measuring the processing of EphA7 by γ-secretase, comprising a first biological composition containing γ-secretase or a biologically active fragment thereof and a second biological composition containing EphA7.

Effect of the Invention

According to the present invention, there are provided a method for screening for compounds which affect the processing of EphA7 by γ-secretase and a kit for use in the method. The compound screened by the present invention can be a therapeutic for a memory disorder of interest, especially dementia (preferably AD).

BEST MODE FOR CARRYING OUT THE INVENTION

Hereinbelow, the present invention will be described in more detail. The present specification encompasses the contents disclosed in the specification and the drawings of U.S. Provisional Patent Application No. 60/988,203 (filed on Nov. 15, 2007) based on which the present patent application claims priority.

The term "patient" used herein refers to an animal, preferably a mammal.

The term "mammal" used herein means any animal classified as mammal, including human and non-human mammals (such as mouse, rat, hamster, guinea pig, rabbit, pig, dog, horse, cattle, monkey, etc.). Preferably, the mammal in the present specification is human. When the mammal is human, the term "patient" include adults and children, and also male and female. Children include newborn infants, infants and adolescents.

The term "γ-secretase" used herein means an enzyme or a complex composed of a plurality of molecules, each of which is in charge of the production of Aβ by cleaving (degrading) APP within its transmembrane domain. The plurality of molecules comprise at least one molecule selected from presenilin, nicastrin, Aph-1 and Pen-2. Examples of the γ-secretase of the present invention include mouse Presenilin 1 (NM_008943), rat Presenilin 1 (D82363), human Presenilin 1 (NM_000021), mouse Presenilin 2 (NM_011183), rat Presenilin 2 (NM_031087), human Presenilin 2 (NM_000447), mouse Nicastrin (NM_021607), rat Nicastrin (NM_174864), human Nicastrin (NM_015331), mouse Aph-1 (NM_146104), rat Aph-1 (NM_001014255), human Aph-1 (NM_016022), mouse Pen-2 (NM_025498), rat Pen-2 (NM_001008764) and human Pen-2 (NM_172341). Each component molecule of the γ-secretase of the present invention may be a full-length molecule or a part thereof, as long as that γ-secretase has an enzyme activity equivalent to that of γ-secretase functioning in vivo. Further, the γ-secretase of the present invention may be a mutant γ-secretase. The mutant γ-secretase is a polypeptide composed of full-length component molecules which may have deletion, substitution, insertion and/or addition of one or more (preferable one or several) amino acids, or a polypeptide having an amino acid sequence comprising a combination of such mutations, each of the above polypeptide having an enzyme activity equivalent to that of γ-secretase functioning in vivo.

The term "cleavage of EphA7" used herein refers to an event in which EphA7, cut by γ-secretase, produces a fragment shorter than the initial EphA7 before cutting. The term "EphA7 undegraded product" used herein refers to a polypeptide which is produced as a result of non-cleavage of EphA7; this polypeptide means the EphA7 polypeptide before degradation by γ-secretase.

The term "biologically active fragment of γ-secretase" means a fragment having an enzyme activity equivalent to that of γ-secretase functioning in vivo. Examples of such fragments include fragments capable of cleaving APP or EphA7.

It should be noted that sometimes, the term "γ-secretase" is intended to include the "biologically active fragment of γ-secretase" in the present specification.

The term "EphA7" used herein refers to a known polypeptide which is a member of the Eph family involved in the synapse formation and/or maintenance (Ciossek T, et al., Brain Res Mol Brain Res. 1999 Dec. 10; 74(1-2):231-6). Examples of the EphA7 of the present invention include human EphA7 (NM_004440, BC126125 and AB209269), rat EphA7 (NM_134331 and U21955), mouse EphA7 (AK030480, NM_010141, BC026153, AK033903, X79084 and X81466), dog (*Canis familiaris*) EphA7 (XM_848830, XM_863019, XM_862939, XM_862929, XM_532234, XM_862959, XM_862952, XM_862920, XM_862975, XM_863004, XM_862945, XM_863007, XM_862992, XM_862967 and XM_862949), horse (*Equus caballus*) EphA7 (XM_001503790), cattle (*Bos Taurus*) EphA7 (XM_611161), chiken (*Gallus gallus*) EphA7 (NM_205083) and platypus (*Ornithorhynchus anatinus*) EphA7 (XM_001506722). Among them, mammal EphA7 polypeptides are preferable.

EphA7 comprises a γ-secretase cleavage site, a transmembrane domain and a kinase activity site in its structure (Aoto, J et al., Brain Res 2006 11); the ligand thereof is the Ephrin A family (Aoto, J et al., Brain Res 2006 11).

In the present invention, EphA7 may be a polypeptide derived from any of the above-listed animals, a recombinant polypeptide or a synthetic polypeptide.

The EphA7 of the present invention may be either a full-length polypeptide or a partial sequence thereof, as long as it comprises the γ-secretase cleavage site of EphA7.

Further, in the present invention, EphA7 may be a mutant EphA7. The mutant EphA7 means a full-length EphA7 polypeptide which may have deletion, substitution, insertion and/or addition of one or more (preferable one or several) amino acids, or an EphA7 polypeptide having an amino acid sequence comprising a combination of such mutations, each of the above polypeptides being functionally substantially identical with EphA7. The polypeptide which is "functionally substantially identical with EphA7" means a polypeptide having an activity of EphA7, for example, a polypeptide which has a cleavage activity in a γ-secretase-dependent manner.

Genes encoding the above-described EphA7 and the above-described EphA7 polypeptides are included in the EphA7 of the present invention. Table 1 below shows correspondence between various animal-derived EphA7 polypeptides and their nucleotide or amino acid sequences. Table 2 below shows correspondence between various animal-derived γ-secretases and their nucleotide or amino acid sequences.

TABLE 1

| Source or Type | Accession No. | Nucleotide Sequence | Amino Acid Sequence |
| --- | --- | --- | --- |
| Human | NM_004440 | SEQ ID NO: 1 | SEQ ID NO: 2 |
| (*Homo sapiens*) | BC126125 | SEQ ID NO: 3 | SEQ ID NO: 4 |
|  | AB209269 | SEQ ID NO: 5 | SEQ ID NO: 6 |
| Rat | NM_134331 | SEQ ID NO: 7 | SEQ ID NO: 8 |
| (*Rattus norvegicus*) | U21955 | SEQ ID NO: 9 | SEQ ID NO: 10 |
| Rat-HA |  | SEQ ID NO: 11 | SEQ ID NO: 12 |
| (*Rattus norvegicus*) |  |  |  |
| Mouse | AK030480 | SEQ ID NO: 13 | SEQ ID NO: 14 |
| (*Mus musculus*) | NM_010141 | SEQ ID NO: 15 | SEQ ID NO: 16 |
|  | BC026153 | SEQ ID NO: 17 | SEQ ID NO: 18 |
|  | AK033903 | SEQ ID NO: 19 | SEQ ID NO: 20 |
|  | X79084 | SEQ ID NO: 21 | SEQ ID NO: 22 |
|  | X81466 | SEQ ID NO: 23 | SEQ ID NO: 24 |
| Dog | XM_848830 | SEQ ID NO: 25 | SEQ ID NO: 26 |
| *Canis familiaris*) | XM_863019 | SEQ ID NO: 27 | SEQ ID NO: 28 |
|  | XM_862939 | SEQ ID NO: 29 | SEQ ID NO: 30 |
|  | XM_862929 | SEQ ID NO: 31 | SEQ ID NO: 32 |
|  | XM_532234 | SEQ ID NO: 33 | SEQ ID NO: 34 |
|  | XM_862959 | SEQ ID NO: 35 | SEQ ID NO: 36 |
|  | XM_862952 | SEQ ID NO: 37 | SEQ ID NO: 38 |
|  | XM_862920 | SEQ ID NO: 39 | SEQ ID NO: 40 |
|  | XM_862975 | SEQ ID NO: 41 | SEQ ID NO: 42 |
|  | XM_863004 | SEQ ID NO: 43 | SEQ ID NO: 44 |
|  | XM_863007 | SEQ ID NO: 45 | SEQ ID NO: 46 |
|  | XM_862992 | SEQ ID NO: 47 | SEQ ID NO: 48 |
|  | XM_862967 | SEQ ID NO: 49 | SEQ ID NO: 50 |
|  | XM_862949 | SEQ ID NO: 51 | SEQ ID NO: 52 |
| Horse | XM_001503790 | SEQ ID NO: 53 | SEQ ID NO: 54 |
| (*Equus caballus*) |  |  |  |
| Cattle (*Bos Taurus*) | XM_611161 | SEQ ID NO: 55 | SEQ ID NO: 56 |
| Chicken | NM_205083 | SEQ ID NO: 57 | SEQ ID NO: 58 |
| (*Gallus gallus*) |  |  |  |
| Platypus | XM_001506722 | SEQ ID NO: 59 | SEQ ID NO: 60 |
| (*Ornithorhynchus anatinus*) |  |  |  |

TABLE 2

| Source or Type | Accession No. | Nucleotide Sequence | Amino Acid Sequence |
| --- | --- | --- | --- |
| Mouse Presenilin 1 (*Mus musculus*) | NM_008943 | SEQ ID NO: 61 | SEQ ID NO: 62 |
| Rat Presenilin 1 (*Rattus norvegicus*) | D82363 | SEQ ID NO: 63 | SEQ ID NO: 64 |
| Human Presenilin 1 (*Homo sapiens*) | NM_000021 | SEQ ID NO: 65 | SEQ ID NO: 66 |
| Mouse Presenilin 2 (*Mus musculus*) | NM_011183 | SEQ ID NO: 67 | SEQ ID NO: 68 |
| Rat Presenilin 2 (*Rattus norvegicus*) | NM_031087 | SEQ ID NO: 69 | SEQ ID NO: 70 |
| Human Presenilin 2 (*Homo sapiens*) | NM_000447 | SEQ ID NO: 71 | SEQ ID NO: 72 |
| Mouse Nicastrin (*Mus musculus*) | NM_021607 | SEQ ID NO: 73 | SEQ ID NO: 74 |
| Rat Nicastrin (*Rattus norvegicus*) | NM_174864 | SEQ ID NO: 75 | SEQ ID NO: 76 |
| Human Nicastrin (*Homo sapiens*) | NM_015331 | SEQ ID NO: 77 | SEQ ID NO: 78 |
| Mouse Aph-1 (*Mus musculus*) | NM_146104 | SEQ ID NO: 79 | SEQ ID NO: 80 |
| Rat Aph-1 (*Rattus norvegicus*) | NM_001014255 | SEQ ID NO: 81 | SEQ ID NO: 82 |
| Human Aph-1 (*Homo sapiens*) | NM_016022 | SEQ ID NO: 83 | SEQ ID NO: 84 |
| Mouse Pen-2 (*Mus musculus*) | NM_025498 | SEQ ID NO: 85 | SEQ ID NO: 86 |
| Rat Pen-2 (*Rattus norvegicus*) | NM_001008764 | SEQ ID NO: 87 | SEQ ID NO: 88 |
| Human Pen-2 (*Homo sapiens*) | NM_172341 | SEQ ID NO: 89 | SEQ ID NO: 90 |

The term "substitution" used herein means preferably conservative substitution in which one or more (preferably one or several) amino acid residues are substituted with other chemically similar amino acid residues so that the activity of the peptide is not substantially modified. Examples of conservative substitution include substitution of a hydrophobic residue with other hydrophobic residue and substitution of a polar residue with other polar residue with the same electric charge. Functionally similar amino acids which allow such substitution are known to those skilled in the art for each amino acid. Specifically, examples of non-polar (hydrophobic) amino acids include alanine, valine, isoleucine, leucine, proline, tryptophan, phenylalanine and methionine; examples of polar (neutral) amino acids include glycine, serine, threonine, tyrosine, glutamine, asparagine and cystein. Examples of positively charged (basic) amino acids include arginine, histidine and lysine. Examples of negatively charged (acidic) amino acids include aspartic acid and glutamic acid.

The number of amino acids which may be deleted, substituted, inserted and/or added as described above is, for example, 1 to 30, preferably 1 to 20, more preferably 1 to 10, still more preferably 1 to 5, particularly preferably 1 to 2.

The mutant EphA7 mentioned above is a polypeptide which consists of an amino acid sequence having preferably 80% or more, more preferably 85% or more, still more preferably 90% or more, still yet more preferably 95% or more, particularly preferably 98% or more, most preferably 99% or more homology (identity) with the amino acid sequence of the polypeptide shown in Table 1 (e.g., polypeptide consisting of SEQ ID NO: 8 or 10) and has substantially the same activity as that of EphA7 (e.g., an activity to change postsynapse morphology, especially to cause change in a γ-secretase degradation activity-dependent manner). As long as these conditions are satisfied, the mutant EphA7 may be a polypeptide derived from any of the above-listed animals, a recombinant polypeptide or a synthetic polypeptide.

The identity described above may be values calculated by homology search programs known to those skilled in the art. For example, identity can be calculated by using default parameters in the homology algorithm BLAST (Basic local alignment search tool; http://www.ncbi.nlm.nih.gov/BLAST/) of The National Center for Biotechnology Information (NCBI).

All EphA7 derivatives comprising at least the γ-secretase cleavage site of EphA7 are included in the EphA7 of the present invention includes. These polypeptides are particularly useful in detecting and purifying EphA7.

The EphA7 may take any of the following forms: a fusion polypeptide fused to other polypeptide, a tagged or labeled polypeptide or a polypeptide otherwise modified. These polypeptides may be obtained by recombinant DNA techniques, site-directed mutagenesis, treatment with mutagenic agents (such as hydroxylamine), or automated peptide synthesis.

Examples of particularly useful systems as tagged EphA7 polypeptides include hemagglutinin (HA) system, glutathione-5-transferase (GST) system, maltose-binding protein system, 6× histidine system, 8× histidine system and the like.

Examples of modification incorporating the above-mentioned label or other detectable moieties include biotin label, radioactive label, fluorescence label, chemiluminescence label and the like. Any EphA7 of the present invention may be labeled with one, two or more of these labels.

For monitoring the cleavage of EphA7 by γ-secretase, any of the following antibodies may be used: an anti-EphA7 antibody; an antibody which recognizes EphA7 undegraded product produced as a result of non-cleavage of EphA7; an antibody which recognizes EphA7 cleavage product produced as a result of the cleavage of EphA7; preferably, an antibody which recognizes the intercellular domain of EphA7; or still preferably, an antibody which recognizes the C-terminal domain of EphA7. When a cleavage product of tagged EphA7 polypeptide or undegraded product is to be detected, an antibody which recognizes the selected tag may be used. For example, when an HA tag has been added to the C-terminus of EphA7, it is possible to detect EphA7 undegraded product or the cleavage of EphA7 using an anti-HA tag antibody. In this case, the antibody is capable of clarifying the presence and concentration of a C-terminal fragment of EphA7 produced as a result of non-cleavage of EphA7 or the presence and concentration of a C-terminal fragment of EphA7 produced as a result of cleavage of EphA7.

In a preferred embodiment of the present invention, EphA7 is a rat EphA7 polypeptide, for example, a polypeptide comprising the amino acid sequence as shown in SEQ ID NO: 8 or 10. In a still preferred embodiment of the present invention, EphA7 is a rat EphA7 polypeptide to which an HA tag is added. For example, a rat EphA7 polypeptide with an HA tag added at its C-terminus (SEQ ID NO: 12) may be given (Example 1). It is for granted that polypeptides comprising the entire human EphA7 amino acid sequence or a part thereof (e.g., the amino acid sequence as shown in SEQ ID NO: 2, 4 or 6) may also be used in the same manner as rat EphA7 polypeptides.

The present invention further provides a polynucleotide comprising a nucleotide sequence encoding the above-described EphA7. One example of the polynucleotide encoding the EphA7 of the present invention is a polynucleotide encoding a rat EphA7 (e.g., the polynucleotide as shown in SEQ ID NO: 7 or 9). In a preferred embodiment of the present invention, the polynucleotide encoding EphA7 is a polynucleotide encoding an HA-tagged rat EphA7 polypeptide. For example, a polynucleotide encoding a rat EphA7 polypeptide with an HA tag added at its C-terminus (SEQ ID NO: 11) may be given (Example 1). It is for granted that polynucleotides comprising the entire human EphA7 nucleotide sequence or a part thereof (e.g., the nucleotide sequence as shown in SEQ ID NO: 1, 3 or 5) may also be used in the same manner as rat EphA7 polynucleotides.

The polynucleotide encoding the EphA7 of the present invention may be a polynucleotide encoding the above-described EphA7 mutant or EphA7 derivative. For example, a polynucleotide which comprises a nucleotide sequence having 80% or more, preferably 85% or more, still more preferably 90% or more, yet still more preferably 95% or more, particularly preferably 98% or more, most preferably 99% or more homology (identity) with the nucleotide sequence as shown in SEQ ID NO: 7 or SEQ ID NO: 9 and encodes a polypeptide having substantially the same activity as that of EphA7 may be included.

Further, the polynucleotide encoding the EphA7 of the present invention includes a polynucleotide which hybridizes to a polynucleotide consisting of a nucleotide sequence complementary to the nucleotide sequence as shown in SEQ ID NO: 7 or SEQ ID NO: 9 under stringent conditions and yet encodes a polypeptide having substantially the same activity as that of EphA7. The stringent conditions refer to, for example, "2×SSC, 0.1% SDS, 42° C." or "1×SSC, 0.1% SDS, 37° C." as washing conditions after hybridization. As more stringent conditions, "1×SSC, 0.1% SDS, 65° C." or "0.5× SSC, 0.1% SDS, 50° C." may be given, for example. More specifically, a method using Rapid-hyb buffer (Amersham Life Science) may be employed in which pre-hybridization is performed at 68° C. for more than 30 minutes; then, with addition of a probe, a hybrid is formed while keeping the reaction solution at 68° C. for more than 1 hour, followed by washing in 2×SSC, 0.1% SDS at room temperature for 20 minutes 3 times, washing in 1×SSC, 0.1% SDS at 37° C. for 20 minutes 3 times and finally washing in 1×SSC, 0.1% SDS at 50° C. for 20 minutes twice. Alternatively, other method may be employed in which pre-hybridization is performed in Expresshyb Hybridization Solution (CLONTECH) at 55° C. for more than 30 minutes; then, with addition of a labeled probe, the reaction solution is incubated at 37-55° C. for more than 1 hour, followed by washing in 2×SSC, 0.1% SDS at room temperature for 20 minutes 3 times, washing in 1×SSC, 0.1% SDS at 37° C. for 20 minutes once. In these methods, more stringent conditions may be achieved, for example, by raising the temperature of prehybridization, hybridization or the second washing. For example, the temperatures of prehybridization and hybridization may be raised to 60° C., respectively; for more stringent conditions, the temperatures may be raised to 68° C., respectively. Those skilled in the art could appropriately select conditions for obtaining EphA7 isoforms, allelic mutants, and corresponding genes derived from other organisms, by taking into account various conditions such as probe concentration, probe length, reaction time, etc. in addition to the above-described salt concentrations and reaction temperatures.

Such polynucleotides may be obtained by gene amplification techniques, hybridization techniques, recombinant DNA techniques, and the like.

The term "biological composition" used herein means a composition comprising γ-secretase or a biologically active fragment thereof, or EphA7, and is not particularly limited. For example, the biological composition may be a cell-free reconstruction system, a mammal or a part thereof, or a transgenic non-human mammal so engineered to overexpress APP or a part of this transgenic mammal.

In the expressions "first biological composition containing γ-secretase or a biologically active fragment thereof" and "second biological composition containing EphA7" used herein, the γ-secretase or EphA7 may be either endogenous or exogenous.

When the γ-secretase or EphA7 is endogenous, the composition may be any composition as long as it contains γ-secretase or EphA7 derived from the above-mentioned animal or a part thereof.

The term "a part of the above-mentioned animal" include tissues, cells, cell lysates, cell membrane fractions or purified membranes of the above-mentioned animal. As examples of the cells, cells in the central nervous system; neurons such as brain-derived neurons, cerebral cortex-derived neurons, cerebral cortex-derived primarily cultured neurons, or hippocampus-derived primarily cultured neurons; or glial cells may be enumerated. The γ-secretase or EphA7 may be in the state of being contained in a mammal or a part thereof. Alternatively, the γ-secretase or EphA7 may be a γ-secretase fraction or a EphA7 fraction of cell lysate prepared from a mammal. The cell lysate may be obtained by subjecting γ-secretase- or EphA7-containing cells to lysis with a hypotonic solution or surfactant, or to sonication or other physical disruption. Optionally, the cell lysate may be purified with some purification means such as columns.

When the γ-secretase or EphA7 is exogenous, the biological composition may be γ-secretase expressing cells or EphA7 expressing cells prepared by allowing host cells to express the whole or a part of the sequences in expression vectors comprising a polynucleotide encoding the individual molecules constituting γ-secretase or a polynucleotide encoding EphA7. Alternatively, the biological composition may be the γ-secretase fraction of a cell lysate derived from γ-secretase expressing cells, or the EphA7 fraction or cell membrane fraction of a cell lysate derived from EphA7 expressing cells. The cell lysate may be obtained by subjecting γ-secretase- or EphA7-containing cells to lysis with a hypotonic solution or surfactant, or to sonication or physical disruption. Optionally, the cell lysate may be purified with some purification means such as columns. The expression vector may be a vector which is transformed or transfected into a host cell and temporarily expresses the gene of interest. Alternatively, the expression vector may be a vector which is integrated into the genome of a host cell and expresses the gene of interest stably.

The term "transformation" or "transfection" used herein means any and all methods which change DNA contents in eukaryotic cells or microorganisms. These methods include calcium phosphate transfection, protoplast fusion transfection, electroporation transfection, DEAE-dextran transfection, liposome transfection, polybrene transfection and direct microinjection transfection (Sambrook, et al., Molecular Cloning 3: 16.30-16.31 (1989)).

The host cell into which the above-described expression vector is to be transformed or transfected may be any cell (or cell line) or microorganism capable of expressing the gene of interest. Known cultured cells may be used as host cells. Examples of mammal cells or cell lines which may be used as host cells include HEK 293 cells, Chinese hamster ovary (CHO) cells, fibroblast cells, primary endothelial cells (HUVEC cells), human glioma cells, HeLa cells, COS cells, PC12 cells, lymphoblast cells, melanoma cells, hybridoma cells, oocytes and embryonic stem cells. Examples of known microorganisms which may be used as host cells include *Escherichia coli* and yeast. Insect cells such as BmN4 cells may also be used.

The expression vector used in the above-described transformation or transfection is not particularly limited as long as the vector comprises a polynucleotide encoding the individual molecules constituting γ-secretase or a polynucleotide encoding EphA7. Such an expression vector may be a plasmid obtainable by introducing the polynucleotide into a known expression vector selected appropriately depending on the host cell to be used.

Examples of the above-mentioned known expression vector include pUC, pTV, pGEX, pKK or pTrcHis for *E. coli*; pEMBLY or pYES2 for yeast; pcDNA3, pMAMneo and pBabe Puro for CHO cells, HEK293 cells or COS cells; and a vector comprising the polyhedrin promoter of *Bombyx mori* nuclear polyhedrosis virus (BmNPV) (such as pBK283) for BmN4 cells.

For example, since a promoter functions effectively in generating strong transcription activity in mammal cells, it is preferred that an expression plasmid comprises a promoter. Examples of promoters to be used for this purpose include CMV immediate early promoter, retrovirus promoters (e.g., LTR from MLV or MMTV), promoters of SV40, RSV LTR, HIV-1 LTR and HIV-2 LTR, adenovirus promoters (e.g., those from E1A region, E2A region or MLP region), and promoters of AAV LTR, cauliflower mosaic virus, HSV-TK and avian sarcoma virus.

The above-described transformed or transfected host cell is not particularly limited as long as the host cell comprises a polynucleotide encoding the individual molecules constituting γ-secretase or a polynucleotide encoding EphA7. For example, the transformed cell may be a transformant in which the polynucleotide has been integrated into the chromosome thereof. Alternatively, the transformed cell may be a transformant comprising the polynucleotide in the form of a plasmid. It is also possible that the transformed cell is a transformant which is not expressing γ-secretase or EphA7. These transformants may be obtained by transforming a desired host cell with the above-mentioned plasmid or the above-described polynucleotide per se.

Cells containing the above-described γ-secretase and/or EphA7 are not particularly limited as long as the cell is capable of expressing γ-secretase and/or EphA7 on the surface of its cell membrane. As examples of such cells, a cell expressing endogenous γ-secretase and endogenous EphA7, a cell expressing γ-secretase and EphA7 one of which is endogenous and the other is exogenous or a cell expressing exogenous γ-secretase and exogenous EphA7 may be given. Such cells may also be obtained by culturing under conditions which allow expression of γ-secretase and/or EphA7. Alternatively, such cells may be obtained by injecting into an appropriate cell an RNA encoding the individual molecules constituting γ-secretase and/or an RNA encoding EphA7 and culturing the resultant cell under conditions which allow expression of γ-secretase and/or EphA7.

The above-described cell membrane fraction may be obtained, for example, by disrupting cells expressing the γ-secretase or EphA7 of the present invention and isolating cell membrane-rich fractions. As methods for disrupting cells, homogenizing in a homogenizer; disrupting in a Waring blender or Polytron; disrupting by sonication; ejecting cells from a thin nozzle while applying pressure with a French press; and so on may be used. As methods for fractionating cell membrane, fractionation methods with centrifugal force such as differential centrifugation or density gradient centrifugation may be used.

For purification, a known method for protein purification may be used. The method comprises a step of crudely fractionating cells into polypeptide fractions and non-polypeptide fractions. After the γ-secretase or EphA7 of the present invention has been isolated from other polypeptides with a column or the like, the desired γ-secretase or EphA7 is further purified by chromatography or electrophoresis to thereby achieve partial purification or complete purification (or homogeneity by purification). Examples of analysis methods particularly suitable for preparation/purification of pure peptides include precipitation using ammonium sulfate, PEG antibodies, etc.; centrifugation after thermal denaturation; chromatography step (ion exchange chromatography, gel filtration chromatography, reversed-phase chromatography, hydroxyapatite chromatography, affinity chromatography, fast protein liquid chromatography (FPLC), high performance liquid chromatography (HPLC) and immobilized metal affinity chromatography (IMAC)); isoelectric focusing; gel electrophoresis; SDS (sodium dodecyl sulfate)-polyacrylamide gel electrophoresis (SDS-PAGE); and a combination of these methods and other method. Alternatively, γ-secretase or EphA7 may be tagged in advance; then, a crude polypeptide may be applied to a purification column to which a protein that recognizes the tag has been bound; the desired γ-secretase or EphA7 adsorbed onto the column may be desorbed from the column by feeding an appropriate solvent thereinto. Various purification steps may be performed in a different order, or some of the steps may be omitted. A preferable method for evaluating the purity of a fraction is a method in which the specific activity of the fraction is calculated and compared with the specific activity of the first extract, followed by calculation of the magnitude of purity for evaluation.

The term "APP" used herein β-amyloid precursor protein (βAPP) or a mutant thereof APP is a single-pass transmembrane protein comprising an Aβ domain in its C-terminal region, expressed in a large variety of cells in many mammals. In human, APP is encoded by the gene APP located in the long arm of chromosome No. 21 and has three major isotypes (APP695, APP751 and APP770). APP695, APP751 and APP770 consist of 695, 751 and 770 amino acid residues, respectively. Examples of APP proteins include human APP695 (NM_201414, NP_958817 and P05067-4), human APP751 (NM_201413, NP 958816 and P5067-8), human APP770 (NM_000484, NP_000475, P05067-1 and P05067), mouse APP695 (NM_007471, NP_031497 and P12023-2), mouse APP751 (P12023-3), mouse APP770 (AY267348, AAP23169, P12023-1 and P12023), rat APP695 (P08592-2), rat APP751 (P08592-7) and rat APP770 (NM_019288, NP_062161, P08592-1 and P08592). Examples of APP mutants include Swedish FAD double mutant, London mutant, valine 717 to phenylalanine mutant, valine 717 to isoleucine mutant and valine 717 to glycine mutant.

The term "Aβ" used herein means the term β-amyloid protein, amyloid β protein, β-amyloid peptide, amyloid β peptide or amyloid beta. For example, Aβ is a peptide consisting of about 33-44 amino acids residues in human APP695 amino acid isotype. Preferably, Aβ includes any peptide comprising a part or all of the amino acid residues from positions 597 to 640 in APP, and means every peptide produced from APP by its N-terminal protein degradation and subsequent C-terminal protein degradation. Aβ40 and Aβ42 are peptides comprising 40 amino acid residues and 42 amino acid residues, respectively.

The term "Notch" used herein refers to one of the competing substrates for γ-secretase belonging to the cell surface receptor Notch family. For example, human Notch 1 (AF308602.1), mouse Notch 1 (NM_008714.2) and rat Notch 1 (NM_001105721.1) may be enumerated. Since Notch 1 has an important function in hematopoiesis, inhibition of the processing of Notch 1 may potentially cause immunodeficiency and anemia.

The term "candidate compound" used herein means a compound which is tested in the compound screening method. Although every molecule may be used as a candidate compound, preferably a compound capable of changing the activity of γ-secretase (preferably the activity of γ-secretase of mammals) is used. The candidate compound is one or more compounds contained in expression products of gene libraries; natural or synthetic low molecular weight compound libraries; nucleic acids (oligo DNA or oligo RNA); natural or synthetic peptide libraries; antibodies; substances released from bacteria (including those released from bacteria as a result of metabolism); cell (from microorganisms, plant cells or animal cells) extracts; cell (microorganism, plant cell or animal cell) culture supernatants; purified or partially purified peptides; extracts from marine organisms, plants or animals; soils; or random phage peptide display libraries. The above-described compound may be either a novel compound or a known compound.

Further, the above-described compound may be a compound modified by conventional chemical means, physical means and/or biochemical means. For example, the above-described compound may be a structural analogue which is obtained by subjecting the initial compound to direct chemical modification (such as acylation, alkylation, esterification or amidation) or random chemical modification. The candidate compound may also be a compound identified by pharmacophore search of the above-described compound or structure comparison programs with computer. The candidate compound may be in the form of a salt. Further, the candidate compound or a salt thereof may be in the form of a solvate (including hydrate).

Further, the candidate compound may be a known γ-secretase accelerator or γ-secretase inhibitor involved in the processing of APP and/or the processing of Notch, or a structural analogue of the above accelerator or inhibitor. A known compound which accelerates or inhibits the activity of γ-secretase and/or the processing of APP and/or the processing of Notch may be a compound that can be designed through rational drug design. For example, DAPT (N—[N-(3,5-difluorophenacetyl)-L-alanyl]-S-phenylglycine t-butyl ester), CM256 and (2S)-2-{[(3,5-difluorophenyl)acetyl]amino}-N-[(3S)-1-methyl-2-oxo-5-phenyl-2,3-dihydro-1H-1,4-benzodiazepin-3-yl]propanamide (Alexis Biochemicals) may be enumerated.

The expression "compound which affects the processing of EphA7 by γ-secretase" used herein means either a compound which inhibits the EphA7 cleavage activity by γ-secretase (γ-secretase inhibitor) or a compound which accelerates the EphA7 cleavage activity by γ-secretase (γ-secretase accelerator). It should be noted that γ-secretase inhibitor includes antagonist and that γ-secretase accelerator includes agonist. γ-Secretase inhibitor and γ-secretase accelerator also include those compounds which alter the cleavage site of EphA7 cleavage products by γ-secretase to thereby produce EphA7 cleavage products with different peptide lengths.

The term "salt" used herein refers to a pharmacologically acceptable salt, and is not particularly limited as long as it forms a pharmacologically acceptable salt with the above-described compound. Preferred examples thereof are hydrohalogenic acid salts (such as hydrofluoride, hydrochloride, hydrobromide or hydroiodide), inorganic acid salts (such as sulfate, nitrate, perchlorate, phosphate, carbonate or hydrogencarbonate), organic carboxylic acid salts (such as acetate, oxalate, maleate, tartrate, fumarate or citrate), organic sulfonic acid salts (such as methanesulfonate, trifluoromethanesulfonate, ethanesulfonate, benzenesulfonate, toluenesulfonate or camphorsulfonate), amino acid salts (such as aspartate or glutamate), quaternary amine salts, alkali metal salts (such as lithium salt, sodium salt or potassium salt) and alkaline earth metal salts (such as magnesium salt or calcium salt).

According to the first embodiment of the present invention, there are provided (a) an assay method for examining the cleavage of EphA7 and (b) a method of secondarily evaluating whether or not a candidate compound affects γ-secretase (screening method) utilizing the assay method. The method of the present invention is as described below. The method of the present invention is characterized by the use of EphA7, a novel substrate for γ-secretase. The method of the present invention may be performed in an in vitro appropriate cell system or a cell-free system.

The first embodiment of the present invention is capable of evaluating the cleavage of EphA7 by γ-secretase, by incubating EphA7 and γ-secretase in the presence and absence of a candidate compound.

The method of screening for compounds which affect the processing of EphA7 by γ-secretase (that is the first embodiment of the present invention) comprises the following steps:
(i) contacting a first biological composition containing γ-secretase or a biologically active fragment thereof with a second biological composition containing EphA7 in the presence and absence of a candidate compound;
(ii) measuring the cleavage of the EphA7 in the presence and absence of the candidate compound;
(iii) selecting those candidate compounds which affect the cleavage of the EphA7 by γ-secretase; and
(iv) identifying the candidate compounds selected in step (iii) as compounds which affect the processing of EphA7 by γ-secretase.

The method of this embodiment may be performed in an appropriate cell system containing γ-secretase and EphA7 or a cell-free system containing γ-secretase and EphA7.

The cell system containing γ-secretase and EphA7 may be either a cell system expressing endogenous genes or a cell system containing an exogenous gene(s). It is possible to contact a first biological composition containing γ-secretase with a second biological composition containing EphA7 by culturing a cell containing γ-secretase and EphA7 in an appropriate medium in the presence and absence of a candidate compound and incubating the cell under reaction conditions which allow the cleavage of EphA7 by γ-secretase activity. If a cell system containing an exogenous gene(s) is used, the above-described contact may be performed under culture conditions which allow the expression of the exogenous gene. It is also possible to apply conditions that allow the cleavage of other γ-secretase substrate, e.g., reaction conditions known to those skilled in the art when the substrate is APP.

Examples of reaction conditions are enumerated below. For cell systems expressing endogenous genes, in the case of primary culture of neurons, culture conditions are in MEM (Invitrogen) medium supplemented with 5% FBS (Hyclone), 1×B27 Supplement (Invitrogen), 0.5 mM L-glutamine (Invitrogen), 25 μg/ml insulin (SIGMA) and 8 μM AraC (SIGMA); under 5% $CO_2$ and at 37° C. For cell systems containing an exogenous gene(s), in the case of HEK293 cell line, culture conditions are in 10% FBS (Hyclone)/DMEM (Invitrogen), under 5% $CO_2$ and at 37° C.

In cell-free systems, a first biological composition containing γ-secretase or a biologically active fragment thereof (e.g., cell membrane fraction containing γ-secretase) and a second biological composition containing EphA7 (e.g., cell membrane fraction containing EphA7) may be contacted with each other by incubating these compositions by mixing them in the presence and absence of a candidate compound. These compositions may be mixed under reaction conditions which allow the cleavage of EphA7 by γ-secretase activity, e.g., 10 mM HEPES, pH 7.4, 150 mM NaCl, 10% glycerol, 5 mM EDTA, 5 mM 1,10-phenanthroline, 10 μg/ml phosphoramidon, Complete protease inhibitor cocktail (Roche Biochemicals) (Tomita et al., Molecular Neurodegeneration 2006 1:2). Alternatively, these compositions may be mixed under conditions which allow the cleavage of other γ-secretase substrate, e.g., reaction conditions known to those skilled in the art when the substrate is APP. γ-Secretase or EphA7 may be a purified γ-secretase or EphA7, a biologically active fragment of γ-secretase or EphA7, an analogue of γ-secretase or EphA7, or a mutant of γ-secretase or EphA7. By contacting a first biological composition containing γ-secretase with a second biological composition containing EphA7 as described above, EphA7 cleavage reaction by γ-secretase occurs.

The candidate compound may be added generally within a range from approx. 1 nM to 1 mM, usually within a range from approx. 10 μM to 1 mM. In order to identify a compound which changes the cleavage of EphA7 by γ-secretase, the steps described above are performed in the presence and absence of a candidate compound. Then, the EphA7 cleavage activity of γ-secretase in the presence of the candidate compound is compared with that activity in the absence of the candidate compound to evaluate the effect of the candidate compound. By these procedures, it is possible to identify compounds which change the cleavage of EphA7 by γ-secretase. Even a slight change in the quantity or degree of EphA7 in the presence of a candidate compound indicates that the EphA7 cleavage activity of γ-secretase has been changed in the presence of the candidate compound. Therefore, the candidate compound can be identified as a compound which affects the processing of EphA7 by γ-secretase. For example, a compound which increases EphA7 cleavage product or decreases EphA7 undegraded product compared with control is evaluated as an accelerator for the EphA7 degradation activity of γ-secretase. On the other hand, a compound which decreases EphA7 cleavage product or increases EphA7 undegraded product compared with control is evaluated as an inhibitor for the EphA7 degradation activity of γ-secretase. The accelerator for the EphA7 degradation activity of γ-secretase obtained by the method of the present invention is potentially useful for treatment of AD.

When EphA7 is tagged, it is possible to detect EphA7 undegraded product or cleavage product using a substance which binds to the tag (e.g., antibody). For example, when EphA7 has a hemagglutinin tag added to its C-terminus, EphA7 products may be detected using a known anti-HA antibody.

Analysis of EphA7 cleavage is performed by measuring an indicator of cleavage for one or both of the N-terminal fragment and C-terminal fragment of EphA7. For analyzing the cleavage of EphA7 by γ-secretase, the following antibodies may be used: anti-EphA7 antibodies, antibodies that recognize EphA7 derivative before degradation by γ-secretase (EphA7 undegraded product), antibodies that recognize EphA7 cleavage product produced as a result of EphA7 cleavage, or antibodies that recognize the intracellular domain of EphA7.

For detecting a tagged undegraded product of EphA7 and/or a tagged cleavage product of EphA7, an antibody to the selected tag may be used.

For example, when an undegraded product of EphA7 polypeptide is to be detected, an HA tag may be added to the C-terminus of EphA7, followed by detection with an anti-HA tag antibody. In this case, it is possible to clarify the presence and concentration of a C-terminal fragment of EphA7 produced as EphA7 undegraded product, by detecting or quantitatively determining the HA tag. When EphA7 or tagged EphA7 is labeled, it is possible to detect its undegraded product by detecting or quantitatively determining the label.

On the other hand, when a cleavage product of EphA7 polypeptide is to be detected, the membrane fraction is purified from EphA7-expressing cells; then, the purified membrane fraction is subjected to cleavage reaction by γ-secretase to thereby allow the EphA7 cleavage product to be released from the membrane fraction. When this reaction product is centrifuged, the EphA7 undegraded product is precipitated into the membrane fraction. Thus, the membrane fraction and other fractions can be separated. By detecting the released fragment, the EphA7 cleavage product can be detected. For this detection, an antibody recognizing the intracellular domain of EphA7 is used when endogenous EphA7 is used. When exogenous recombinant EphA7 is used, a cDNA encoding EphA7 with a tag sequence added to its C-terminus is used to express the recombinant EphA7. Then, the EphA7 cleavage product is detected using an antibody that recognizes the tag. The tag is not particularly limited. For example, HA, Myc, FLAG or the like may be used.

The antibody to EphA7 is not particularly limited as long as the antibody recognizes EphA7. Preferably, an antibody which recognizes the intracellular domain of EphA7 is used. Those skilled in the art could prepare an antibody which recognizes EphA7 by immunizing an animal with an immunogen (antigen) and following the conventional, general procedures for preparing monoclonal antibodies. As the immunogen for example, EphA7 or a fragment thereof, or a fusion protein prepared by adding a tag or label to EphA7 or a fragment thereof may be used.

For example, a non-human mammal is immunized with the immunogen alone or, if necessary, together with Freund's adjuvant. Polyclonal antibodies may be obtained from the serum collected from the immunized animal. Monoclonal antibodies may be obtained by fusing antibody producing cells from the immunized animal with myeloma cells without autoantibody producing ability to prepare fusion cells (hybridomas), cloning the hybridomas, and selecting those clones which produce a monoclonal antibody showing specific affinity to the antigen used for immunizing the animal. The preparation of monoclonal antibodies from hybridomas may be performed in vitro. Alternatively, the preparation may be performed in vivo in a non-human mammal, preferably mouse or rat, more preferably in the abdominal dropsy in mouse. Monoclonal antibodies may be isolated from the resultant culture supernatant or the abdominal dropsy of the mammal. The isolation and purification of monoclonal antibodies may be performed by subjecting the above-mentioned culture supernatant or abdominal dropsy to methods such as saturated ammonium sulfate precipitation, euglobulin precipitation, caproic acid method, caprilic acid method, ion exchange chromatography (DEAE, DE52, etc.), or affinity column chromatography using anti-immunoglobulin column or protein A column. The monoclonal antibody include those monoclonal antibodies consisting of heavy chains and/or light chains having the amino acid sequences which have deletion, substitution or addition of one or several amino acids in the heavy chains and/or light chains constituting the initial antibody.

In another embodiment of the present invention, it is possible to evaluate whether or not a candidate compound affects the processing of APP and/or Notch, in parallel with, simultaneously with, or before or after the above-described first embodiment of the present invention. For example, a step of measuring the cleavage of APP or a polypeptide containing an APP cleavage site by γ-secretase (i.e., polypeptide containing APP γ-secretase cleavage site) may be included in parallel with, simultaneously with, or before or after the above-described method of the present invention. Further, a step of measuring the cleavage of Notch or a polypeptide containing a Notch cleavage site by γ-secretase (i.e., polypeptide containing Notch γ-secretase cleavage site) may be included.

By including such steps, it is possible to evaluate whether or not a candidate compound selectively acts on the processing of EphA7 compared to the processing of APP and/or Notch. The expression "selectively act on" used herein means to have more inhibitory effect or accelerating effect upon the cleavage of substrate EphA7 by γ-secretase than upon the cleavage of other substrate(s). Specifically, according to this embodiment of the present invention, it is possible to identify a compound which selectively acts only on the processing of EphA7; a compound which selectively acts only on the processing of APP; a compound which selectively acts only on the processing of Notch; or a compound which selectively acts on the processing of APP and EphA7.

As a candidate compound in drug development, a compound which acts in the same manner as metabolic activity in healthy animals in vivo or a compound which regulates the metabolic activity is preferable. A preferable example of such a candidate compound is a compound which inhibits the production of Aβ42 by inhibiting the APP cleavage activity of γ-secretase, does not inhibit the EphA7 cleavage activity of γ-secretase, and does not inhibit the Notch cleavage activity of γ-secretase. Another preferable example is a compound which inhibits the production of Aβ42 by accelerating the production of Aβ40 through acceleration of the APP cleavage activity of γ-secretase; accelerates the processing of EphA7 by accelerating the EphA7 cleavage activity of γ-secretase; and does not inhibit the Notch cleavage activity of γ-secretase.

As methods for measuring the cleavage by γ-secretase of APP, Notch or a polypeptide containing an APP or Notch γ-secretase cleavage site, assay methods known to those skilled in the art may be applicable (Song et al. PNAS 1999 96 6959-6963; Moehlmann et al. PNAS 2002 99 8025-8030). For example, a first biological composition containing γ-secretase or a biologically active fragment thereof may be contacted with a biological composition containing APP or a polypeptide containing an APP γ-secretase cleavage site or a biological composition containing Notch or a polypeptide containing a Notch γ-secretase cleavage site in the presence and absence of a candidate compound, and then the cleavage of the APP or the polypeptide containing an APP γ-secretase cleavage site or the cleavage of the Notch or the polypeptide containing a Notch γ-secretase cleavage site. This measurement may be performed by measuring the cleavage product from the APP or the polypeptide containing an APP γ-secretase cleavage site or the cleavage product from the Notch or the polypeptide containing a Notch γ-secretase cleavage site. As one example of the cleavage product from APP or a polypeptide containing an APP γ-secretase cleavage site, Aβ may be given. The quantity of Aβ may be measured, and changes in the quantity between the presence and absence of the candidate compound may be compared. Alternatively, the degree of cleavage and the quantity of cleavage product may be measured by using a known antibody which recognizes the cleavage product from APP or a polypeptide containing an APP γ-secretase cleavage site or the cleavage product from Notch or a polypeptide containing a Notch γ-secretase cleavage site. As the antibody which recognizes the cleavage product from APP or a polypeptide containing an APP γ-secretase cleavage site, commercial antibodies (Sigma or Chemicon) may be used. The measurement may be performed, for example, by Western blotting. As the antibody which recognizes the cleavage product from Notch or a polypeptide containing a Notch γ-secretase cleavage site, commercial antibodies (Santacruze) may be used. The measurement may be performed, for example, by Western blotting.

The method of the present invention also includes a method of evaluating the morphology of postsynapses or the function of neurotransmission, using those compounds identified by the above-described method of the present invention. For example, the evaluation of the morphology of postsynapses is carried out by evaluating the number and the shape of spines (Pak D et al. Neuron 2001 31:289-303). The evaluation of the function of neurotransmission is carried out, for example, by evaluating electrical changes occurring on the synapse membrane using cultured cells or cultured slices (Saura et al., Neuron 2004 42: 23-36).

The method of the present invention also includes a high through put screening (HTS) known to those skilled in the art, which tests a large number of compounds simultaneously (U.S. Pat. No. 5,876,946; U.S. Pat. No. 5,902,732; Jayawickreme and Kost, Curr. Opin. Biotechnol., 8, pp. 629-634, 1997; Houston and Banks, Curr. Opin. Biotechnol., 8, pp. 734-740, 1997).

The method of the present invention also includes the use of known model animals. It is possible to analyze the in vivo effect of a compound selected by the in vitro method of the present invention by using, for example, non-human models for APP processing and/or AD. APP transgenic non-human animal models are well-known in the art. For example, Tg2576 mouse (J. Neurosci. 21(2), 372-381, 2001; J. Clin. Invest., 112, 440-449, 2003) may be used. For example, the following evaluations may be made after administering to Tg2576 mouse a known γ-secretase inhibitor DAPT, (2S)-2-{[(3,5-difluorophenyl)acetyl]amino}-N-[(3S)-1-methyl-2-oxo-5-phenyl-2,3-dihydro-1H-1,4-benzodiazepin-3-yl]propanamide (Alexis Biochemicals) or a compound of the present invention: evaluation by a method of measuring the Aβ quantities in the brain, cerebrospinal fluid and serum of the mouse (J. Pharmacol. Exp. Ther. 305, 864-871, 2003); pathological examination of changes in the brain (e.g., changes in Aβ yield, the degree of cerebral atrophy, etc.) resulted from changes in γ-secretase activity; and evaluation of the survival ratio, momentum or food consumption of the mouse.

The pharmaceutical composition comprising the compound identified by the method of the present invention, preferably the AD therapeutic of the present invention, may be administered to patients in various forms through an oral or parenteral (e.g., intravenous injection, muscle injection, subcutaneous administration, rectal administration or transdermal administration) route. Therefore, the pharmaceutical composition comprising the compound of the present invention may be formulated into various preparations using a pharmacologically acceptable carrier by a conventional method depending on the administration route, though the pharmaceutical composition may be used alone. Preferred dosage forms include oral preparations such as tablets, powders, subtle granules, granules, coated tablets, capsules, syrups and troches; and parenteral preparations such as inhalants, suppositories, injections (including drops), ointments, eye drops, ophthalmic ointments, nasal drops, ear drops, cataplasms, and lotions and liposomes.

Examples of carriers used in the formulation include conventionally used fillers, binders, disintegrants, lubricants, coloring agents and flavoring agents, as well as stabilizers, emulsifiers, absorbefacients, surfactants, pH adjusting agents, antiseptics, antioxidants, expanders, wetting agents, surface activators, dispersing agents, buffers, preservatives, dissolution aids and analgesic agents according to necessity. They can be formulated according to a conventional procedure using components commonly used as raw materials for pharmaceutical preparations. Examples of nontoxic these components which may be used in the present invention include animal and vegetable oils such as soybean oil, beef tallow and synthetic glycerides; hydrocarbons such as liquid paraffins, squalane and solid paraffins; ester oils such as octyldodecyl myristate and isopropyl myristate; higher alcohols such as cetostearyl alcohol and behenyl alcohol; silicone resins; silicone oils; surfactants such as polyoxyethylene fatty acid esters, sorbitan fatty acid esters, glycerin fatty acid esters, polyoxyethylene sorbitan fatty acid esters, polyoxyethylene hydrogenated castor oils and polyoxyethylene-polyoxypropylene block copolymers; water-soluble polymers such as hydroxyethyl cellulose, polyacrylic acids, carboxyvinyl polymers, polyethylene glycol, polyvinylpyrrolidone and methylcellulose; lower alcohols such as ethanol and isopropanol; polyhydric alcohols (polyols) such as glycerol, propylene glycol, dipropylene glycol, sorbitol and polyethylene glycol; sugars such as glucose and sucrose; inorganic powders such as silicic anhydride, magnesium aluminium silicate and aluminium silicate; inorganic salts such as sodium chloride and sodium phosphate; and purified water.

The fillers include, for example, lactose, fructose, corn starch, white sugar, glucose, mannitol, sorbitol, crystalline cellulose and silicon dioxide. The binders include, for example, polyvinyl alcohol, polyvinyl ether, methylcellulose, ethylcellulose, gum arabic, gum tragacanth, gelatin, shellac, hydroxypropyl methylcellulose, hydroxypropyl cellulose, polyvinylpyrrolidone, polypropylene glycol-polyoxyethylene block polymers and meglumine. The disintegrants include, for example, starch, agar, gelatin powder, crystalline cellulose, calcium carbonate, sodium hydrogencarbonate, calcium citrate, dextrin, pectin and carboxymethylcellulose calcium. The lubricants include, for example, magnesium stearate, talc, polyethylene glycol, silica and hardened vegetable oils. The coloring agents may be any coloring agents which are approved to be added to pharmaceutical preparations. The flavoring agents include, for example, cocoa powder, menthol, aromatic powder, peppermint oil, camphol and cinnamon powder. The above-listed components may be in the form of a salt or solvate thereof.

The oral preparation is produced by mixing the compound of the present invention with a filler, and if necessary, a binder, disintegrant, lubricant, coloring agent, flavoring agent, etc. and formulating the mixture according to conventional procedures into, for example, a powder, subtle granules, granules, tablet, coated tablet, capsules or the like. Resultant tablets and granules can be appropriately coated with, for example, sugar according to necessity. The syrups and injection preparations can be prepared according to conventional procedures by adding a pH adjusting agent, solubilizer, and isotonizing agent, and if necessary, a dissolution aid, stabilizer, etc. The external preparations can be produced according to conventional procedures not specifically limited. Base materials which may be used in the present invention include various raw materials conventionally used in pharmaceutical preparations, quasi drugs and cosmetics. Such raw materials include, for example, animal and vegetable oils, mineral oils, ester oils, waxes, higher alcohols, fatty acids, silicone oils, surfactants, phospholipids, alcohols, polyhydric alcohols, water-soluble polymers, clay minerals and purified water. If necessary, pH adjusting agents, antioxidants, chelating agents, antiseptics and antimolds, coloring agents, flavors, or the like can be added. In addition, components such as blood-flow accelerators, bactericides, anti-inflammatory agents, cell activators, vitamins, amino acids, humectants, keratolytic agents or the like be added according to necessity. The ratio of the active ingredient to carriers may vary from 1 to 90% by weight. When the compounds used in the present invention, the peptides used in the present invention or the polynucleotides used in the present invention are used in the above-described treatment, it is preferable to use those compounds, peptides or polynucleotides purified to 90% or more, preferably 95% or more, more preferably 98% or more, still more preferably 99% or more.

The effective dose of the pharmaceutical composition comprising the compound of the present invention varies depending on the severity of symptom, the age, sex and body weight of the patient, administration mode, type of the salt, specific type of the disease and other factors. Generally, the pharmaceutical composition may be administered to an adult (body weight: 60 kg) in one to several divided doses at a daily dose of about 30 µg to about 10 g, preferably 100 µg to 5 g, and more preferably 100 µg to 100 mg for oral administration, or at a daily dose of about 30 µg to about 1 g, preferably 100 µg to 500 mg, and more preferably 100 µg to 30 mg for injection administration. Considering that efficacy varies depending on the administration route, the required dose is expected to vary widely. For example, it is expected that oral administration requires a higher dose than intravenous injection. When administered to children, the dose may be smaller than the dose for adults. These variations in the dose level can be adjusted by standard empirical optimization procedures which are well understood in the industry.

The term "treatment" is herein to generally mean obtaining a desired pharmacological and/or physiological effect. The effect may be prophylactic in terms of completely or partially preventing a disease and/or a symptom and may be therapeutic in terms of partially or completely curing a disease and/or an adverse effect attributed to the disease. The term "treatment" as used herein covers any treatment of a disease in a patient, preferably a human, and includes at least one treatment selected from the following (a) to (c):
(a) preventing a disease or a symptom from occurring in a patient who may be predisposed to the disease but has not yet been diagnosed as having it;
(b) inhibiting a disease symptom, i.e. preventing or delaying its progress; or
(c) relieving a disease symptom, i.e. causing regression or elimination of the disease or symptom, or causing reversal of the progress of the disease.

For example, as clinical symptoms of AD, progressive disorientation, memory loss and aphasia are enumerated. Finally, disablement, speech loss and akinesia occur. Pathological signs of AD include neurofibrillary tangle, senile plaques and amyloid angiopathy. To prevent the progress of AD is interpreted to mean to prevent the onset or further progress of the clinical symptoms and/or pathological signs of AD. For example, in patients who do not have the clinical symptoms or pathological signs of AD, it is possible to prevent the progress of clinical symptoms or pathological signs. In patients suffering from mild AD, it is possible to prevent the development of more severe AD forms. To delay the progress of AD is interpreted to mean to delay the point of onset of AD-related symptoms and/or pathological signs, or to reduce the speed of progress of AD that is determined by the speed of progress of clinical symptoms and pathological signs. To reverse the progress of AD is interpreted to mean to relieve the severity of AD symptoms, i.e., to change the severity of AD conditions of patients from severe to mild. At that time, the change to mild is indicated by decrease of clinical symptoms or pathological signs.

Diagnosis of AD in patients may be performed by various known methods. Typically, AD is diagnosed by combining clinical and pathological assessments. For example, the progress or severity of AD may be judged using Mini Mental State Examination (MMSE) (Mohs et al. (1996) Int Psychogeriatr 195-203), Alzheimer's Disease Assessment Scale-Cognitive Subscale (ADAS-cog) (Galasko et al., (1997) Alzheimer Dis Assoc Disord, 11 suppl 2: S33-9), Alzheimer's Disease Cooperative Study-Activities of Daily Living (ADCS-ADL) (McKhann et al., (1984) Neurology 34: 939-944) and Criteria of National Institute of Neurologic Communicative Disorders and Stroke-Alzheimer's Disease and Related Disorders Association (NINCDS-ADRDA) (Folstein et al., (1975) J Psychiatr Res 12: 189-198; McKhann et al., (1984) Neurology 34: 939-944). Further, methods which evaluate various regions of the brain and enable the estimation of frequency of senile plaques or neurofibrillary tangle may be used (Braak et al., (1991) Acta Neuropathol 82: 239-259; Khachaturian (1985) Arch Neuro 42: 1097-1105; Mirra et al., (1991) Neurology 41: 479-486; and Mirra et al., (1993) Arch Pathol Lab Med 117: 132-144).

In another embodiment, the present invention provides a kit for assaying γ-secretase, comprising EphA7 and preferably further comprising a substrate for γ-secretase other than EphA7 (preferably APP and/or Notch), or a kit for identifying inhibitors, accelerators or modulators for γ-secretase. These kits of this embodiment may be used in the screening method of the present invention.

The present invention provides a test kit for measuring the processing of EphA7 by γ-secretase. The kit of the present invention comprises γ-secretase or a biological composition containing γ-secretase, and a biological composition containing EphA7. The kit may further comprise a substrate for γ-secretase other than EphA7 (e.g., APP and/or Notch) or a biological composition containing such a substrate. Preferably, the kit comprises a plurality of substrates for γ-secretase. It is preferred that the kit comprises APP and/or Notch in addition to EphA7. Further, the kit may comprise tools (reaction vessels, blotting membranes, etc.) and reagents (buffers, culture broths, anti-EphA7 antibodies, etc.) for use in immunoblotting or Western blotting technology, written instructions, and so forth. With the above-described assay kit of the present invention, it is possible to evaluate whether or not a candidate compound affects the processing of EphA7 by γ-secretase.

Further, the present invention includes the use of the above-described kit in measuring the processing of EphA7, or in methods of screening or testing γ-secretase inhibitors.

EXAMPLES

Hereinbelow, the present invention will be described in more detail with reference to the following Examples and Preparation Examples. However, the present invention is not limited to these Examples, which are provided only for the purpose of full disclosure of the present invention to those skilled in the art. It is not meant or even implied that the experiments described herein are all or only one experiment actually carried out. Although efforts have been made to guarantee the accuracy of the numerical values used herein (e.g., volume, temperature, concentration, etc.), experimental errors and deviations are considered to some extent. Thus, such values may be changed within a range which does not depart from the scope of the present invention.

Example 1

Analysis of EphA7 Processing in EphA7-Transfected 293/EBNA-1 Cell Strain

Whether or not EphA7 is a substrate for γ-secretase was evaluated using HEK293 cells expressing a gene encoding EphA7 with an HA tag added to its C-terminus, in the presence of a γ-secretase inhibitor. As the γ-secretase inhibitor, (2S)-2-{[(3,5-difluorophenyl)acetyl]amino}-N-[(3S)-1-methyl-2-oxo-5-phenyl-2,3-dihydro-1H-1,4-benzodiazepin-3-yl]propanamide (hereinafter, sometimes referred to as "Compound E") (Alexis Biochemicals) was used.
1. Experimental Conditions and Methods
(1) Cloning of Rat EphA 7
RNA was purified from rat brain with Trisol (Invitrogen), followed by synthesis of 1st strand cDNA with RNA PCR Kit (TaKaRa). EphA7 was amplified in two separate fragments of 1-1620 by and 1561 bp-stop. Specifically, EphA7 was amplified using 1 μl of the finally synthesized 1st strand cDNA product, the following primers and Pfu (Stratagene). For 1-1620 by fragment, primer1 and primer2 were used. For 1561 bp-stop fragment, primer3 and primer4 were used.

```
primer1 SalI site-added:
                                          (SEQ ID NO: 91)
GAGGTCGACGCCACCATGGTTGTTCAAACTCGGTACCC primer2:
                                          (SEQ ID NO: 92)
ACCTGAAGCTTCCTCTAGTGTTGC primer3:
                                          (SEQ ID NO: 93)
GCCGGCTATGGAAATTACAGCCC primer4 NotI site-added:
                                          (SEQ ID NO: 94)
GAGGCGGCCGCCACTTGGATGCCGGTTCCGTGTAA
```

PCR conditions were as follows: first reaction at 95° C. for 2 minutes; then 35 cycles of (at 95° C. for 45 seconds→at 60° C. for 45 seconds→at 72° C. for 4 minutes); then final reaction at 72° C. for 7 minutes. The PCR products were purified with Quiaquick PCR purification kit (QIAGEN). Then, 1-1620 by fragment was treated with restriction enzymes SalI (TaKaRa) and HindIII (TaKaRa), and 1561 bp-stop fragment was treated with Hind (TaKaRa) and NotI (TaKaRa). Subsequently, they were cloned into pBluescript (Stratagene) separately to thereby obtain pBluescript 1-1615 by fragment (1-1615 bp) and pBluescript 1610 bp-stop fragment (1610-stop).

The DNA sequences of the resultant pBluescript 1-1615 by fragment and pBluescript 1610 bp-stop fragment were confirmed with a DNA sequencer (Applied Biosystems; 3130× 1). After the confirmation, pBluescript 1-1615 by fragment was treated with HindIII and NotI. Into the thus treated fragment, a fragment cut out from pBluescript 1610 bp-stop fragment with HindIII and NotI was inserted to thereby complete the full-length EphA7.

(2) Construction of a Gene Encoding Rat EphA7 with HA Tag Added to its C-Terminus and an Expression Vector pcDNA (Invitrogen) was treated with restriction enzymes SalI (TaKaRa) and NotI (TaKaRa). EphA7 obtained by treating the pBluescript prepared in (1) above with restriction enzymes SalI (TaKaRa) and NotI (TaKaRa) was inserted into the resultant pcDNA to thereby prepare an expression vector. This expression vector was constructed so that an HA tag is added to the C-terminus of the incorporated EphA7 (EphA7-HA). The DNA sequence of EphA7-HA was analyzed with a DNA sequencer (Applied Biosystems; 3130×1) and is shown in SEQ ID NO: 11. The nucleotide sequence from positions 2992 to 3021 in SEQ ID NO: 11 is a sequence encoding the HA tag. In the resultant DNA sequence, the nucleotide at position 959 was changed from c to a, as compared with that of rat EphA7 (NM_134331). (Hereinafter, this mutation is expressed as "c→a.". Other mutations will also be expressed in the same manner.) Further, the resultant DNA sequence lacked nucleotides from positions 1799 to 1810 (ttaaatttccag; SEQ ID NO: 95). In the amino acid level, the residue at position 320 was changed from Proline to Histidine. Further, the amino acid sequence from positions 600 to 604 (Phenylalanine-Lysine-Phenylalanine-Proline-Glycine: SEQ ID NO: 96) was changed to Cysteine. The resultant expression vector was prepared in large quantity with Endofree Plasmid Maxi Kit (QIAGEN).

(3) Preparation of Cells Expressing the Gene Encoding Rat EphA7 with HA Tag Added to its C-Terminus 293/EBNA-1 cell strain (Invitrogen) was cultured in 10% FBS (Hyclone)/DMEM (Invitrogen) under 5% $CO_2$ at 37° C., followed by transfection thereinto of the gene encoding rat EphA7 with an HA tag added to its C-terminus using Lipofectamine 2000 (Invitrogen). After one day culture under the same conditions, 50 mM Compound E (γ-secretase inhibitor; Alexis Biochemicals) was added to the culture broth. Cells were cultured for another day under the same conditions. Then, the transfected HEK293 cells were collected with PBS (Sigma) and sonicated with a sonicator (Taitec VP-5S) to disrupt cells. Then, the quantity of protein was determined with Protein Assay Kit (BioRad). Samples (2 µg each) were taken from proteins obtained from Compound E-added cells and Compound E-not added cells, respectively, and subjected to SDS-PAGE, followed by Western blotting with an anti-HA antibody (Roche) (final concentration: 0.2 µg/ml).

2. Experimental Results

Figure 1:
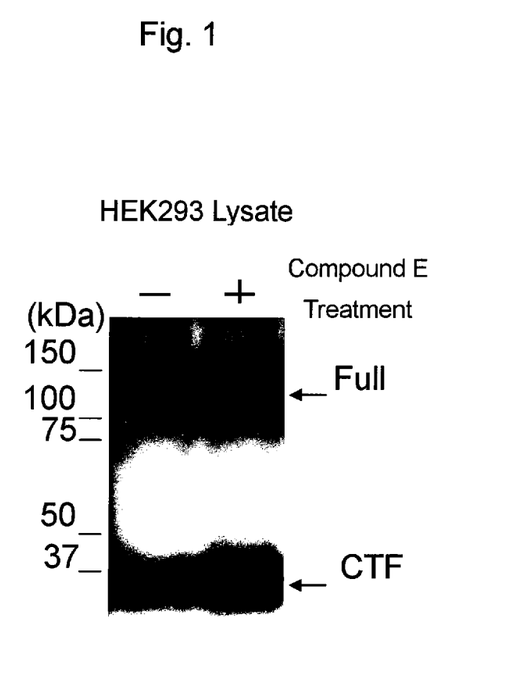
FIG. 1 shows the results of analysis of EphA7 processing using EphA 7-transfected 293/EBNA-1 cell strain.

FIG. 1 shows the results. The left lane represents the sample not treated with Compound E, and the right lane represents the sample treated with Compound E. "Full" represents the full-length of EphA7. "CTF" (C-terminal fragment) represents a region spreading from the transmembrane domain of EphA7 to its C-terminal site. Since CTF was accumulated upon addition of Compound E, it has become clear that EphA7 is cleaved by γ-secretase in HEK293 cells. When Compound E (γ-secretase inhibitor) was added, a band around 50 kDa (CTF) was accumulated specifically. Since this band is equal in size to the region spreading from the transmembrane domain of EphA7 to its C-terminal site, it has become clear that EphA7 is cleaved by γ-secretase in HEK293 cells.

First, the substrate for γ-secretase is cut off its extracellular domain by other protease. Then, γ-secretase further cuts off the transmembrane domain from the resultant digest fragment CTF [from the transmembrane domain (amino acid residue at position 556) to the C-terminus]. The final degradation product (intracellular domain) is rapidly degraded by proteasome. Since reactions proceed very quickly from the first cleavage to the final degradation by proteasome, the substrate is detected as a single band when detected by Western blotting. However, it has been found that accumulation of CTF is detected specifically when the substrate is treated with γ-secretase inhibitor.

The technical terms used herein are used only for the purpose of illustrating a specific embodiment and not intended to limit the embodiment.

Unless otherwise specifically defined, all technical terms and scientific terms used herein have the same meaning as generally understood by those skilled in the art. Although any methods and materials similar to or equivalent to those described herein may be used in the practice or test of the present invention, those skilled in the art can consult the description provided herein, for preferable methods and materials.

All publications cited herein are incorporated herein by reference in their entirety for the purpose of describing and disclosing, for example, the cell systems, constructs and methods described in the publications that are used in connection with the present invention, or incorporated herein as references with respect to the disclosure of the compound identification method, screening method and methodologies therefor, and composition of the present invention; such publications may be used for the practice of the present invention.

SEQUENCE LISTING FREE TEXT

SEQ ID NO: 91: synthetic DNA
SEQ ID NO: 92: synthetic DNA
SEQ ID NO: 93: synthetic DNA
SEQ ID NO: 94: synthetic DNA

SEQUENCE LISTING (96 sequences)

SEQ ID NO: 1 - DNA, 2997 bp, Homo sapiens
  CDS (1)..(2994)
atggtttttcaaactcggtacccttcatggattattttatgctacatctggctgctccgctttgcacacacaggggaggcgcaggctgcgaaggaagtactactgctggattctaaagcacaacaaacagagttggagtggatttcctctccacccaatgggtgggaagaaattagtggtttggatgagaactataccccgatacgaacataccaggtgtgccaagtcatggagcccaaccaaaacaactggctgcggactaactggatttccaaaggcaatgcacaaaggatttttgtagaattgaaattcaccctgagggattgtaacagtcttcctggagtactgggaacttgcaaggaaacatttaatttgtactattatgaaacagactatgacactggcaggaatataagagaaaacctctatgtaaaaatagacaccattgctgcagatgaaagttttacccaaggtgaccttggtgaaagaaagatgaagcttaacactgaggtgagagagattggacctttgtccaaaaagggattctatcttgcctttcaggatgtaggggcttgcatagctttggtttctgtcaaagtgtactacaagaagtgctggtccattattgagaacttagctatctttccagatacagtgactggttcagaattttcctctttagtcgaggttcgagggacatgtgtcagcagtgcagaggaagaagcggaaaacgcccccaggatgcactgcagtgcagaaggagaatggttagtgcccattggaaaatgtatctgcaaagcaggctaccagcaaaaaggagacacttgtgaaccctgtggccgtgggttctacaagtcttcctctcaagatcttcagtgctctcgttgtccaactcacagtttttctgataaagaaggctcctccagatgtgaatgtgaagatgggtattacagggctccatctgacccaccatacgttgcatgcacaaggcctccatctgcaccacagaacctcattttcaacatcaaccaaaccacagtaagtttggaatggagtcctcctgcagacaatgggggaagaaacgatgtgacctacagaatattgtgtaagcggtgcagttgggagcagggcgaatgtgttccctgtgggagtaacattggatacatgccccagcagactggattagaggataactatgtcactgtcatggacctgctagcccacgctaattatacttttgaagttgaagctgtaaatggagtttctgacttaagccgatcccagaggctctttgctgctgtcagtatcaccactggtcaagcagctccctcgcaagtgagcggagtaatgaaggagagagtactgcagcggagtgtcgagctttcctggcaggaaccagagcatcccaatggagtcatcacagaatatgaaatcaagtattacgagaaagatcaaagggaacggacctactcaacagtaaaaaccaagtctacttcagcctccattaataatctgaaaccaggaacagtgtatgttttccagattcgggcttttactgctgctggttatggaaattacagtcccagacttgatgttgctacactagaggaagctacaggtaaaatgtttgaagctacagctgtctccagtgaacagaatcctgttattatcattgctgtggttgctgtagctgggaccatcattttggtgttcatggtctttggcttcatcattgggagaaggcactgtggttatagcaaagctgaccaagaaggcgatgaagagctttactttcattttaaatttccaggcaccaaaacctacattgaccctgaaacctatgaggacccaaatagagctgtccatcaattcgccaaggagctagatgcctcctgtattaaaattgagcgtgtgattggtgcaggagaattcggtgaagtctgcagtggccgtttgaaacttccagggaaaagagatgttgcagtagccataaaaaccctgaaagttggttacacagaaaaacaaaggagagactttttgtgtgaagcaagcatcatggggcagtttgaccacccaaatgttgtccatttggaaggggttgttacaagagggaaaccagtcatgatagtaatagagttcatggaaaatggagccctagatgcatttctcaggaaacatgatgggcaatttacagtcattcagttagtaggaatgctgagaggaattgctgctggaatgagatatttggctgatatgggatatgttcacagggaccttgcagctcgcaatattcttgtcaacagcaatctcgtttgtaaagtgtcagattttggcctgtcccgagttatagaggatgatccagaagctgtctatacaactactggtggaaaaattccagtaaggtggacagcacccgaagccatccagtaccggaaattcacatcagccagtgatgtatggagctatggaatagtcatgtgggaagttatgtcttatggagaaagaccttattgggacatgtcaaatcaagatgttataaaagcaatagaagaaggttatcgtttaccagcacccatggactgcccagctggccttcaccagctaatgttggattgttggcaaaaggagcgtgctgaaaggccaaaatttgaacagatagttggaattctagacaaaatgattcgaaacccaaatagtctgaaaactcccctgggaacttgtagtaggccaataagccctcttctggatcaaaacactcctgatttcactaccttttgttcagttggagaatggctacaagctattaagatggaaagatataaagataatttcacggcagctggctacaattcccttgaatcagtagccaggatgactattgaggatgtgatgagtttagggatcacactggttggtcatcaaaagaaaatcatgagcagcattcagactatgagagcacaaatgctacatttacatggaactggcattcaagtgtga

SEQ ID NO: 2 - protein, 998 aa, Homo sapiens
MVFQTRYPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENAPRMHCSAEGEWLVPIGKCICKAGYQQKGDTCEPCGRGFYKSSSQDLQCSRCPTHSFSDKEGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSASINNLKPGTVYVFQIRAFTAAGYGNYSPRLDVATLEEATGKMFEATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPNSLKTPLGTCSRPISPLLDQNTPDFTTFCSVGEWLQAIKMERYKDNFTAAGYNSLESVARMTIEDVMSLGITLVGHQKKIMSSIQTMRAQMLHLHGTGIQV

SEQ ID NO: 3 - DNA, 2997 bp, Homo sapiens
  CDS (1)..(2994)
atggtttttcaaactcggtacccttcatggattattttatgctacatctggctgctccgctttgcacacacaggggaggcgcaggctgcgaaggaagtactactgctggattctaaagcacaacaaacagagttggagtggatttcctctccacccaatgggtgggaagaaattagtggtttggatgagaactataccccgatacgaacataccaggtgtgccaagtcatggagcccaaccaaaacaactggctgcggactaactggatttccaaaggcaatgcacaaaggatttttgtagaattgaaattcaccctgagggattgtaacagtcttcctggagtactgggaacttgcaaggaaacatttaatttgtactattatgaaacagactatgacactggcaggaatataagagaaaacctctatgtaaaaatagacaccattgctgcagatgaaagttttacccaaggtgaccttggtgaaagaaagatgaagcttaacactgaggtgagagagattggacctttgtccaaaaagggattctatcttgcctttcaggatgtaggggcttgcatagctttggtttctgtcaaagtgtactacaagaagtgctggtccattattgagaacttagctatctttccagatacagtgactggttcagaattttcctctttagtcgaggttcgagggacatgtgtcagcagtgcagaggaagaagcggaaaacgcccccaggatgcactgcagtgcagaaggagaatggttagtgcccattggaaaatgtatctgcaaagcaggctaccagcaaaaaggagacacttgtgaaccctgtggccgtgggttctacaagtcttcctctcaagatcttcagtgctctcgttgtccaactcacagtttttctgataaagaaggctcctccagatgtgaatgtgaagatgggtattacagggctccatctgacccaccatacgttgcatgcacaaggcctccatctgcaccacagaacctcattttcaacatcaaccaaaccacagtaagtttggaatggagtcctcctgcagacaatgggggaagaaacgatgtgacctacagaatattgtgtaagcggtgcagttgggagcagggcgaatgtgttccctgtgggagtaacattggatacatgccccagcagactggattagaggataactatgtcactgtcatggacctgctagcccacgctaattatacttttgaagttgaagctgtaaatggagtttctgacttaagccgatcccagaggctctttgctgctgtcagtatcaccactggtcaagcagctccctcgcaagtgagcggagtaatgaaggagagagtactgcagcggagtgtcgagctttcctggcaggaaccagagcatcccaatggagtcatcacagaatatgaaatcaagtattacgagaaagatcaaagggaacggacctactcaacagtaaaaaccaagtctacttcagcctccattaataatctgaaaccaggaacagtgtatgttttccagattcgggcttttactgctgctggttatggaaattacagtcccagacttgatgttgctacactagaggaagctacaggtaaaatgtttgaagctacagctgtctccagtgaacagaatcctgttattatcattgctgtggttgctgtagctgggaccatcattttggtgttcatggtctttggcttcatcattgggagaaggcactgtggttatagcaaagctgaccaagaaggcgatgaagagctttactttcattttaaatttccaggcaccaaaacctacattgaccctgaaacctatgaggacccaaatagagctgtccatcaattcgccaaggagctagatgcctcctgtattaaaattgagcgtgtgattggtgcaggagaattcggtgaagtctgcagtggccgtttgaaacttccagggaaaagagatgttgcagtagccataaaaaccctgaaagttggttacacagaaaaacaaaggagagactttttgtgtgaagcaagcatcatggggcagtttgaccacccgaatgttgtccatttggaaggggttgttacaagagggaaaccagtcatgatagtaatagagttcatggaaaatggagccctagatgcatttctcaggaaacatgatgggcaatttacagtcattcagttagtaggaatgctgagaggaattgctgctggaatgagatatttggctgatatgggatatgttcacagggaccttgcagctcgcaatattcttgtcaacagcaatctcgtttgtaaagtgtcagattttggcctgtcccgagttatagaggatgatccagaagctgtctatacaactactggtggaaaaattccagtaaggtggacagcacccgaagccatccagtaccggaaattcacatcagccagtgatgtatggagctatggaatagtcatgtgggaagttatgtcttatggagaaagaccttattgggacatgtcaaatcaagatgttataaaagcaatagaagaaggttatcgtttaccagcacccatggactgcccagctggccttcaccagctaatgttggattgttggcaaaaggagcgtgctgaaaggccaaaatttgaacagatagttggaattctagacaaaatgattcgaaacccaaatagtctgaaaactcccctgggaacttgtagtaggccaataagccctcttctggatcaaaacactcctgatttcactaccttttgttcagttggagaatggctacaagctattaagatggaaagatataaagataatttcacggcagctggctacaattcccttgaatcagtagccaggatgactattgaggatgtgatgagtttagggatcacactggttggtcatcaaaagaaaatcatgagcagcattcagactatgagagcacaaatgctacatttacatggaactggcattcaagtgtga

SEQ ID NO: 4 - protein, 998 aa, Homo sapiens; identical to SEQ ID NO: 2

SEQ ID NO: 5 - DNA, 3003 bp, Homo sapiens
  CDS (1)..(3000)
aataaaacctgctcatgcaccatggtttttcaaactcggtacccttcatggattattttatgctacatctggctgctccgctttgcacacacaggggaggcgcaggctgcgaaggaagtactactgctggattctaaagcacaacaaacagagttggagtggatttcctctccacccaatgggtgggaagaaattagtggtttggatgagaactataccccgatacgaacataccaggtgtgccaagtcatggagcccaaccaaaacaactggctgcggactaactggatttccaaaggcaatgcacaaaggatttttgtagaattgaaattcaccctgagggattgtaacagtcttcctggagtactgggaacttgcaaggaaacatttaatttgtactattatgaaacagactatgacactggcaggaatataagagaaaacctctatgtaaaaatagacaccattgctgcagatgaaagttttacccaaggtgaccttggtgaaagaaagatgaagcttaacactgaggtgagagagattggacctttgtccaaaaagggattctatcttgcctttcaggatgtaggggcttgcatagctttggtttctgtcaaagtgtactacaagaagtgctggtccattattgagaacttagctatctttccagatacagtgactggttcagaattttcctctttagtcgaggttcgagggacatgtgtcagcagtgcagaggaagaagcggaaaacgcccccaggatgcactgcagtgcagaaggagaatggttagtgcccattggaaaatgtatctgcaaagcaggctaccagcaaaaaggagacacttgtgaaccctgtggccgtgggttctacaagtcttcctctcaagatcttcagtgctctcgttgtccaactcacagtttttctgataaagaaggctcctccagatgtgaatgtgaagatgggtattacagggctccatctgacccaccatacgttgcatgcacaaggcctccatctgcaccacagaacctcattttcaacatcaaccaaaccacagtaagtttggaatggagtcctcctgcagacaatgggggaagaaacgatgtgacctacagaatattgtgtaagcggtgcagttgggagcagggcgaatgtgttccctgtgggagtaacattggatacatgccccagcagactggattagaggataactatgtcactgtcatggacctgctagcccacgctaattatacttttgaagttgaagctgtaaatggagtttctgacttaagccgatcccagaggctctttgctgctgtcagtatcaccactggtcaagcagctccctcgcaagtgagtggagtaatgaaggagagagtactgcagcggagtgtcgagctttcctggcaggaaccagagcatcccaatggagtcatcacagaatatgaaatcaagtattacgagaaagatcaaagggaacggacctactcaacagtaaaaaccaagtctacttcagcctccattaataatctgaaaccaggaacagtgtatgttttccagattcgggcttttactgctgctggttatggaaattacagtcccagacttgatgttgctacactagaggaagctacagctacagctgtctccagtgaacagaatcctgttattatcattgctgtggttgctgtagctgggaccatcattttggtgttcatggtctttggcttcatcattgggagaaggcactgtggttatagcaaagctgaccaagaaggcgatgaagagctttactttcattttaaatttccaggcaccaaaacctacattgaccctgaaacctatgaggacccaaatagagctgtccatcaattcgccaaggagctagatgcctcctgtattaaaattgagcgtgtgattggtgcaggagaattcggtgaagtctgcagtggccgtttgaaacttccagggaaaagagatgttgcagtagccataaaaaccctgaaagttggttacacagaaaaacaaaggagagactttttgtgtgaagcaagcatcatggggcagtttgaccacccgaatgttgtccatttggaaggggttgttacaagagggaaaccagtcatgatagtaatagagttcatggaaaatggagccctagatgcatttctcaggaaacatgatgggcaatttacagtcattcagttagtaggaatgctgagaggaattgctgctggaatgagatatttggctgatatgggatatgttcacagggaccttgcagctcgcaatattcttgtcaacagcaatctcgtttgtaaagtgtcagattttggcctgtcccgagttatagaggatgatccagaagctgtctatacaactactggtggaaaaattccagtaaggtggacagcacccgaagccatccagtaccggaaattcacatcagccagtgatgtatggagctatggaatagtcatgtgggaagttatgtcttatggagaaagaccttattgggacatgtcaaatcaagatgttataaaagcaatagaagaaggttatcgtttaccagcacccatggactgcccagctggccttcaccagctaatgttggattgttggcaaaaggagcgtgctgaaaggccaaaatttgaacagatagttggaattctagacaaaatgattcgaaacccaaatagtctgaaaactcccctgggaacttgtagtaggccaataagccctcttctggatcaaaacactcctgatttcactaccttttgttcagttggagaatggctacaagctattaagatggaaagatataaagataatttcacggcagctggctacaactcccttgaatcagtagccaggatgactattgaggatgtgatgagtttagggatcacactggttggtcatcaaaagaaaatcatgagcagcattcagactatgagagcacaaatgctacatttacatggaactggcattcaagtgtga

SEQ ID NO: 6 - protein, 1000 aa, Homo sapiens
NKTCSCTMVFQTRYPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENAPRMHCSAEGEWLVPIGKCICKAGYQQKGDTCEPCGRGFYKSSSQDLQCSRCPTHSFSDKEGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSASINNLKPGTVYVFQIRAFTAAGYGNYSPRLDVATLEEATATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPNSLKTPLGTCSRPISPLLDQNTPDFTTFCSVGEWLQAIKMERYKDNFTAAGYNSLESVARMTIEDVMSLGITLVGHQKKIMSSIQTMRAQMLHLHGTGIQV

SEQ ID NO: 7 - DNA, 2997 bp, Rattus norvegicus
  CDS (1)..(2994)
atggttgttcaaactcggtacccttcgtggattattttgtgttacatctggctgcttggctttgcacacacgggggaggcgcaggctgcgaaggaagtactgttactggactcgaaagcacaacaaacagaattggaatggatttcctctccacccagtgggtgggaagaaattagtggtttggatgagaactacacaccaataagaacataccaggtgtgccaggtcatggagcccaaccagaacaactggcttcggactaactggatttctaaaggcaacgcacaaaggatttttgtagaattgaaattcaccttgagggattgtaatagtcttcccggagtcctgggaacttgcaaggaaacctttaatttgtactattatgaaacagactacgacaccggcaggaatatacgagaaaacctttacgttaaaatagacaccattgctgcagatgaaagttttacacaaggtgaccttggtgaaagaaagatgaagctgaacactgaggtgagagagattggacctttgtccaaaaagggattctatcttgcctttcaggatgtaggggcttgcatagcattggtttctgtcaaagtatactacaagaagtgctggtccattattgagaacttagctgtctttccagatacagtgactggttcagaattttcctccttagttgaggtccgtgggacatgtgtcagcagtgccgaggaagaggcagaaaattcacccaggatgcattgcagtgcagaaggagagtggttagtacccattggaaaatgtatctgcaaagcaggctatcagcaaaaaggggacacttgtgaaccctgtggccgcaggttctacaaatcttcctctcaggaccttcagtgttctcgttgtccaacccacagtttctctgaccgagaaggatcatcgaggtgtgaatgtgaagacgggtactacagagctccttctgacccaccatacgtcgcatgcacgaggcctccctctgcaccacagaaccttattttcaacatcaatcaaacgactgtaagtttggagtggagtcctccagctgacaacggaggaagaaacgatgtcacctacagaatattgtgtaagcggtgcagctgggagcagggagaatgtgtaccatgcggaagtaacattggatacatgccccagcagacgggattagaggataactatgtcactgtcatggacctgcttgcccatgcaaattacacgttcgaagttgaagctgtaaatggagtttcagacttaagcagatcccagaggctttttgcagccgttagcatcaccactggtcaagcagctccctcgcaagtgagcggagtgatgaaggagagagtgctgcagcggagtgtggagctttcctggcaggaaccagaacatcccaacggagtcatcacggaatatgaaatcaagtattatgagaaagatcaaagagaaaggacgtactcaacactgaaaaccaagtccacctcagcctccattaataatctgaaaccgggaacagtgtatgtttttcagatccgggcgttcactgctgccggctatggaaattacagccctaggctggatgttgcaacactagaggaagcttcaggtaaaatgtttgaagcaacagcggtgtccagtgaacagaatcccgtcatcataattgctgtggtggctgtagcagggaccatcatcttggtgttcatggtgttcggcttcatcattggaagaaggcactgtggttacagcaaggctgaccaagaaggggatgaagaactctactttcattttaaatttccaggcaccaaaacctacattgaccctgaaacctatgaggacccaaatagagctgtccatcaattcgccaaggagctagatgcctcctgtattaaaattgagcgtgtgattggtgcaggagaatttggagaagtttgcagtggtcgtttgaaacttccagggaaaagagatgttgcagtggctataaaaaccctgaaagttggttacacagaaaaacaaaggagggactttttatgcgaagcaagcatcatggggcaatttgaccacccaaatgtcgtccatttggaaggggttgttacaagagggaagcctgtcatgatcgtgatagagttcatggagaacggcgccctggatgcatttctcaggaaacatgatgggcaatttacagtcattcagttggtaggaatgctgagaggaattgcggctggcatgcgctacttggctgacatgggatacgttcacagggaccttgcggctcgcaacattcttgtgaacagcaatcttgtttgtaaagtgtccgattttggcctgtcccgggttatagaggatgaccccgaagctgtctacacgactactggtggaaaaattccagtaaggtggactgcccctgaagccatccaataccggaaattcacctcagccagtgatgtgtggagctatgggattgtcatgtgggaagtaatgtcttatggagaacgaccttattgggacatgtcgaatcaagatgtcattaaagcgatagaagaaggttatcgcttaccagcacccatggactgcccagctggtcttcaccagctaatgctggattgttggcagaaagaacgggcagagaggccaaagtttgagcagatagtcggaattctagacaaaatgattcgaaatccaagcagtctgaaaacacccctgggaacttgtagcagacccataagccctcttctggaccagagcactcccgacttcactgccttctgttcagtgggagagtggttgcaggctattaaaatggagaggtataaagacaacttcacagcggcaggttacaactcactcgagtcggtggcccggatgaccatcgacgatgtgatgagtttagggatcacactggttggccatcaaaagaagattatgagcagcatccagactatgcgggcacagatgctgcacttacacggaaccggcatccaagtgtga

SEQ ID NO: 8 - protein, 998 aa, Rattus norvegicus
MVVQTRYPSWIILCYIWLLGFAHTGEAQAAKEVLLLDSKAQQTELEWISSPPSGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAVFPDTVTGSEFSSLVEVRGTCVSSAEEEAENSPRMHCSAEGEWLVPIGKCICKAGYQQKGDTCEPCGRRFYKSSSQDLQCSRCPTHSFSDREGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTLKTKSTSASINNLKPGTVYVFQIRAFTAAGYGNYSPRLDVATLEEASGKMFEATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPSSLKTPLGTCSRPISPLLDQSTPDFTAFCSVGEWLQAIKMERYKDNFTAAGYNSLESVARMTIDDVMSLGITLVGHQKKIMSSIQTMRAQMLHLHGTGIQV

SEQ ID NO: 9 - DNA, 1833 bp, Rattus norvegicus
  CDS (1)..(1830)
atggttgttcaaactcggtacccttcgtggattattttgtgttacatctggctgcttggctttgcacacacgggggaggcgcaggctgcgaaggaagtactgttactggactcgaaagcacaacaaacagaattggaatggatttcctctccacccagtgggtgggaagaaattagtggtttggatgagaactacacaccaataagaacataccaggtgtgccaggtcatggagcccaaccagaacaactggcttcggactaactggatttctaaaggcaacgcacaaaggatttttgtagaattgaaattcaccttgagggattgtaatagtcttcccggagtcctgggaacttgcaaggaaacctttaatttgtactattatgaaacagactacgacaccggcaggaatatacgagaaaacctttacgttaaaatagacaccattgctgcagatgaaagttttacacaaggtgaccttggtgaaagaaagatgaagctgaacactgaggtgagagagattggacctttgtccaaaaagggattctatcttgcctttcaggatgtaggggcttgcatagcattggtttctgtcaaagtatactacaagaagtgctggtccattattgagaacttagctgtctttccagatacagtgactggttcagaattttcctccttagttgaggtccgtgggacatgtgtcagcagtgccgaggaagaggcagaaaattcacccaggatgcattgcagtgcagaaggagagtggttagtacccattggaaaatgtatctgcaaagcaggctatcagcaaaaaggggacacttgtgaaccctgtggccgcaggttctacaaatcttcctctcaggaccttcagtgttctcgttgtccaacccacagtttctctgaccgagaaggatcatcgaggtgtgaatgtgaagacgggtactacagagctccttctgacccaccatacgtcgcatgcacgaggcctccctctgcaccacagaaccttattttcaacatcaatcaaacgactgtaagtttggagtggagtcctccagctgacaacggaggaagaaacgatgtcacctacagaatattgtgtaagcggtgcagctgggagcagggagaatgtgtaccatgcggaagtaacattggatacatgccccagcagacgggattagaggataactatgtcactgtcatggacctgcttgcccatgcaaattacacgttcgaagttgaagctgtaaatggagtttcagacttaagcagatcccagaggctttttgcagccgttagcatcaccactggtcaagcagctccctcgcaagtgagcggagtgatgaaggagagagtgctgcagcggagtgtggagctttcctggcaggaaccagaacatcccaacggagtcatcacggaatatgaaatcaagtattatgagaaagatcaaagagaaaggacgtactcaacactgaaaaccaagtccacctcagcctccattaataatctgaaaccgggaacagtgtatgtttttcagatccgggcgttcactgctgccggctatggaaattacagccctaggctggatgttgcaacactagaggaagcttcaggtaaaatgtttgaagcaacagcggtgtccagtgaacagaatcccgtcatcataattgctgtggtggctgtagcagggaccatcatcttggtgttcatggtgttcggcttcatcattggaagaaggcactgtggttacagcaaggctgaccaagaaggggatgaagaactctactttcattctttagtaacaaatgagcatctgtcagttttataa

SEQ ID NO: 10 - protein, 610 aa, Rattus norvegicus
MVVQTRYPSWIILCYIWLLGFAHTGEAQAAKEVLLLDSKAQQTELEWISSPPSGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAVFPDTVTGSEFSSLVEVRGTCVSSAEEEAENSPRMHCSAEGEWLVPIGKCICKAGYQQKGDTCEPCGRRFYKSSSQDLQCSRCPTHSFSDREGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTLKTKSTSASINNLKPGTVYVFQIRAFTAAGYGNYSPRLDVATLEEASGKMFEATAVSSEQNPVIIIAVVAVAGTIILVFMVFGFIIGRRHCGYSKADQEGDEELYFHSLVTNEHLSVL

SEQ ID NO: 11 - DNA, 3024 bp, Rattus norvegicus
  CDS (1)..(3021)
atggttgttcaaactcggtacccttcgtggattattttgtgttacatctggctgcttggctttgcacacacgggggaggcgcaggctgcgaaggaagtactgttactggactcgaaagcacaacaaacagaattggaatggatttcctctccacccagtgggtgggaagaaattagtggtttggatgagaactacacaccaataagaacataccaggtgtgccaggtcatggagcccaaccagaacaactggcttcggactaactggatttctaaaggcaacgcacaaaggatttttgtagaattgaaattcaccttgagggattgtaatagtcttcccggagtcctgggaacttgcaaggaaacctttaatttgtactattatgaaacagactacgacaccggcaggaatatacgagaaaacctttacgttaaaatagacaccattgctgcagatgaaagttttacacaaggtgaccttggtgaaagaaagatgaagctgaacactgaggtgagagagattggacctttgtccaaaaagggattctatcttgcctttcaggatgtaggggcttgcatagcattggtttctgtcaaagtatactacaagaagtgctggtccattattgagaacttagctgtctttccagatacagtgactggttcagaattttcctccttagttgaggtccgtgggacatgtgtcagcagtgccgaggaagaggcagaaaattcacccaggatgcattgcagtgcagaaggagagtggttagtacccattggaaaatgtatctgcaaagcaggctatcagcaaaaaggggacacttgtgaaccctgtggccgcaggttctacaaatcttcctctcaggaccttcagtgttctcgttgtccaacccacagtttctctgaccgagaaggatcatcgaggtgtgaatgtgaagacgggtactacagagctcattctgacccaccatacgtcgcatgcacgaggcctccctctgcaccacagaaccttattttcaacatcaatcaaacgactgtaagtttggagtggagtcctccagctgacaacggaggaagaaacgatgtcacctacagaatattgtgtaagcggtgcagctgggagcagggagaatgtgtaccatgcggaagtaacattggatacatgccccagcagacgggattagaggataactatgtcactgtcatggacctgcttgcccatgcaaattacacgttcgaagttgaagctgtaaatggagtttcagacttaagcagatcccagaggctttttgcagccgttagcatcaccactggtcaagcagctccctcgcaagtgagcggagtgatgaaggagagagtgctgcagcggagtgtggagctttcctggcaggaaccagaacatcccaacggagtcatcacggaatatgaaatcaagtattatgagaaagatcaaagagaaaggacgtactcaacactgaaaaccaagtccacctcagcctccattaataatctgaaaccgggaacagtgtatgtttttcagatccgggcgttcactgctgccggctatggaaattacagccctaggctggatgttgcaacactagaggaagcttcaggtaaaatgtttgaagcaacagcggtgtccagtgaacagaatcccgtcatcataattgctgtggtggctgtagcagggaccatcatcttggtgttcatggtgttcggcttcatcattggaagaaggcactgtggttacagcaaggctgaccaagaaggggatgaagaactctactttcattgcaccaaaacctacattgaccctgaaacctatgaggacccaaatagagctgtccatcaattcgccaaggagctagatgcctcctgtattaaaattgagcgtgtgattggtgcaggagaatttggagaagtttgcagtggtcgtttgaaacttccagggaaaagagatgttgcagtggctataaaaaccctgaaagttggttacacagaaaaacaaaggagggactttttatgcgaagcaagcatcatggggcaatttgaccacccaaatgtcgtccatttggaaggggttgttacaagagggaagcctgtcatgatcgtgatagagttcatggagaacggcgccctggatgcatttctcaggaaacatgatgggcaatttacagtcattcagttggtaggaatgctgagaggaattgcggctggcatgcgctacttggctgacatgggatacgttcacagggaccttgcggctcgcaacattcttgtgaacagcaatcttgtttgtaaagtgtccgattttggcctgtcccgggttatagaggatgaccccgaagctgtctacacgactactggtggaaaaattccagtaaggtggactgcccctgaagccatccaataccggaaattcacctcagccagtgatgtgtggagctatgggattgtcatgtgggaagtaatgtcttatggagaacgaccttattgggacatgtcgaatcaagatgtcattaaagcgatagaagaaggttatcgcttaccagcacccatggactgcccagctggtcttcaccagctaatgctggattgttggcagaaagaacgggcagagaggccaaagtttgagcagatagtcggaattctagacaaaatgattcgaaatccaagcagtctgaaaacacccctgggaacttgtagcagacccataagccctcttctggaccagagcactcccgacttcactgccttctgttcagtgggagagtggttgcaggctattaaaatggagaggtataaagacaacttcacagcggcaggttacaactcactcgagtcggtggcccggatgaccatcgacgatgtgatgagtttagggatcacactggttggccatcaaaagaagattatgagcagcatccagactatgcgggcacagatgctgcacttacacggaaccggcatccaagtggcggccgcagactacccatacgacgtcccagactacgcttag

SEQ ID NO: 12 - protein, 1007 aa, Rattus norvegicus
MVVQTRYPSWIILCYIWLLGFAHTGEAQAAKEVLLLDSKAQQTELEWISSPPSGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAVFPDTVTGSEFSSLVEVRGTCVSSAEEEAENSPRMHCSAEGEWLVPIGKCICKAGYQQKGDTCEPCGRRFYKSSSQDLQCSRCPTHSFSDREGSSRCECEDGYYRAHSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTLKTKSTSASINNLKPGTVYVFQIRAFTAAGYGNYSPRLDVATLEEASGKMFEATAVSSEQNPVIIIAVVAVAGTIILVFMVFGFIIGRRHCGYSKADQEGDEELYFHCTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPSSLKTPLGTCSRPISPLLDQSTPDFTAFCSVGEWLQAIKMERYKDNFTAAGYNSLESVARMTIDDVMSLGITLVGHQKKIMSSIQTMRAQMLHLHGTGIQVAAADYPYDVPDYA

SEQ ID NO: 13 - DNA, 2997 bp, Mus musculus
  CDS (1)..(2994)
atggttgttcaaactcggttcccttcgtggattattttgtgttacatctggctgcttggctttgcacacacgggggaggcgcaggctgcgaaggaagtactattactggactcgaaagcacaacaaacagaattggaatggatttcctctccacccagtgggtgggaagaaattagtggtttggatgagaactacactccgataagaacataccaggtgtgccaggtcatggagcccaaccagaacaactggctgcggactaactggatttctaaaggcaacgcacaaaggatttttgtagaattgaaattcaccttgagggattgtaatagtcttcccggagtcctgggaacttgcaaggaaacgtttaatttgtactattatgaaacagactacgacaccggcaggaatatacgagaaaacctttatgttaaaatagacaccattgctgcagatgaaagtttcacacaaggtgaccttggtgaaagaaagatgaagctgaacactgaggtgagagagattggacctttgtccaaaaagggattctatcttgcctttcaggatgtaggggcttgcatagcattggtttctgtcaaagtgtactacaagaagtgctggtccattgttgagaacttagctgtctttccagatacagtgactggttcggaattttcctccttagtcgaggtccgtgggacatgtgtcagcagtgccgaggaagaggcagaaaattcccccagaatgcattgcagtgcagaaggagagtggctagtacccattggaaaatgcatctgcaaagcaggctatcagcaaaaaggggacacttgcgaaccctgtggccgcaggttctacaaatcttcctctcaggatctccagtgttctcgttgtccaacccacagcttctctgaccgagaaggatcatccaggtgtgaatgtgaagatgggtactacagagctccttctgatccaccatacgttgcatgcacgaggcctccctctgcaccacagaaccttattttcaatatcaatcaaacgactgtaagtttggaatggagtcctccggctgacaacgggggaagaaacgatgtcacctacagaatactgtgtaagcggtgcagttgggaacagggagaatgtgtgccatgcggaagtaacattggatacatgccccagcagacgggattagaggataactatgtcactgtcatggacctacttgcccatgcaaattacactttcgaagttgaagctgtaaatggagtttcggacttaagcagatcccagaggctcttcgctgctgttagcatcaccaccggtcaagcagctccctcgcaagtgagtggagtcatgaaggagcgagtactgcagcggagtgtgcagctttcctggcaggagccggagcatcccaatggagtcatcacggaatatgaaatcaagtattatgagaaagatcaacgggaaaggacgtactcaacactcaaaaccaagtccacctccgcctccattaataatctgaaaccgggaacagtgtacgtctttcagatccgggcggtcactgctgccggttatggaaactacagccctaggcttgatgttgccacacttgaggaagcttcaggtaaaatgtttgaagcgacagcagtctccagtgaacagaatcctgtcatcataattgctgtagtggctgtagcagggaccatcatcttggtgttcatggtgttcggcttcatcattggaagaaggcactgtggttatagcaaggctgaccaagaaggggatgaagaactctactttcattttaaatttccaggcaccaaaacctacattgaccctgaaacctatgaggacccaaatagagctgtccatcaattcgccaaggagctagatgcctcctgtattaaaattgagcgtgtgattggtgcaggagaatttggagaagtttgcagtggtcgtttgaaacttccggggaagagagatgttgcagtggccataaaaaccctgaaagttggttacacagaaaagcaaaggagggactttttatgcgaagcaagcatcatggggcaatttgaccacccaaatgtcgtccatttggaaggggttgttacaagagggaagcctgtcatgattgtgatagagttcatggagaatggagccctggatgcatttctcaggaaacacgatgggcagtttacagtcattcagttggtaggaatgttgagaggtattgccgctgggatgcgatacttggctgatatgggatacgttcacagggaccttgcagcgcgcaacatccttgtcaacagcaatcttgtttgtaaagtgtcagattttggcctttcccgggttatagaggatgatcccgaagctgtctacaccacgactggtggaaaaattccagtaaggtggactgcaccggaagccattcaataccggaagttcacctcagccagcgatgtgtggagctatgggattgtcatgtgggaagtgatgtcttatggagaaagaccttactgggacatgtcaaatcaagatgtcattaaagcgatagaagaaggttatcgtttgccggcgcccatggattgcccagctggtcttcaccagctaatgctggattgttggcagaaagatcgggcggaaaggccaaagtttgagcagatagtcggaattctagacaaaatgattcgaaacccaagtagtctgaaaacacccctgggaacttgtagtagacccttaagccctcttctggaccagagcactcctgacttcactgccttctgttcagttggagaatggttgcaagctattaaaatggaaaggtataaggacaacttcacagcagcgggttacaactcactcgagtcagtggccaggatgactatcgatgatgtgatgagtttagggatcacactggttggccatcaaaagaagatcatgagcagcatccagactatgcgggcacaaatgttgcatttacacggaacaggcatccaagtgtga

SEQ ID NO: 14 - protein, 998 aa, Mus musculus
MVVQTRFPSWIILCYIWLLGFAHTGEAQAAKEVLLLDSKAQQTELEWISSPPSGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIVENLAVFPDTVTGSEFSSLVEVRGTCVSSAEEEAENSPRMHCSAEGEWLVPIGKCICKAGYQQKGDTCEPCGRRFYKSSSQDLQCSRCPTHSFSDREGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVQLSWQEPEHPNGVITEYEIKYYEKDQRERTYSTLKTKSTSASINNLKPGTVYVFQIRAVTAAGYGNYSPRLDVATLEEASGKMFEATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKDRAERPKFEQIVGILDKMIRNPSSLKTPLGTCSRPLSPLLDQSTPDFTAFCSVGEWLQAIKMERYKDNFTAAGYNSLESVARMTIDDVMSLGITLVGHQKKIMSSIQTMRAQMLHLHGTGIQV

SEQ ID NO: 15 - DNA, 2997 bp, Mus musculus
  CDS (1)..(2994)
atggttgttcaaactcggttcccttcgtggattattttgtgttacatctggctgcttggctttgcacacacgggggaggcgcaggctgcgaaggaagtactattactggactcgaaagcacaacaaacagaattggaatggatttcctctccacccagtgggtgggaagaaattagtggtttggatgagaactacactccgataagaacataccaggtgtgccaggtcatggagcccaaccagaacaactggctgcggactaactggatttctaaaggcaacgcacaaaggatttttgtagaattgaaattcaccttgagggattgtaatagtcttcccggagtcctgggaacttgcaaggaaacgtttaatttgtactattatgaaacagactacgacaccggcaggaatatacgagaaaacctttatgttaaaatagacaccattgctgcagatgaaagtttcacacaaggtgaccttggtgaaagaaagatgaagctgaacactgaggtgagagagattggacctttgtccaaaaagggattctatcttgcctttcaggatgtaggggcttgcatagcattggtttctgtcaaagtgtactacaagaagtgctggaccattgttgagaacttagctgtctttccagatacagtgactggttcggaattttcctccttagtcgaggtccgtgggacatgtgtcagcagtgccgaggaagaggcagaaaattcccccagaatgcattgcagtgcagaaggagagtggctagtacccattggaaaatgcatctgcaaagcaggctatcagcaaaaaggggacacttgcgaaccctgtggccgcaggttctacaaatcttcctctcaggatctccagtgttctcgttgtccaacccacagcttctctgaccgagaaggatcatccaggtgtgaatgtgaagatgggtactacagagctccttctgatccaccatacgttgcatgcacgaggcctccctctgcaccacagaaccttattttcaatatcaatcaaacgactgtaagtttggaatggagtcctccggctgacaacgggggaagaaacgatgtcacctacagaatactgtgtaagcggtgcagttgggaacagggagaatgtgtgccatgcggaagtaacattggatacatgccccagcagacgggattagaggataactatgtcactgtcatggacctacttgcccatgcaaattacactttcgaagttgaagctgtaaatggagtttcggacttaagcagatcccagaggctcttcgctgctgttagcatcaccaccggtcaagcagctccctcgcaagtgagtggagtcatgaaggagcgagtactgcagcggagtgtgcagctttcctggcaggagccggagcatcccaatggagtcatcacggaatatgaaatcaagtattatgagaaagatcaacgggaaaggacgtactcaacactcaaaaccaagtccacctccgcctccattaataatctgaaaccgggaacagtgtacgtctttcagatccgggcggtcactgctgccggttatggaaactacagccctaggcttgatgttgccacacttgaggaagcttcaggtaaaatgtttgaagcgacagcagtctccagtgaacagaatcctgtcatcataattgctgtagtggctgtagcagggaccatcatcttggtgttcatggtgttcggcttcatcattggaagaaggcactgtggttatagcaaggctgaccaagaaggggatgaagaactctactttcattttaaatttccaggcaccaaaacctacattgaccctgaaacctatgaggacccaaatagagctgtccatcaattcgccaaggagctagatgcctcctgtattaaaattgagcgtgtgattggtgcaggagaatttggagaagtttgcagtggtcgtttgaaacttccgggccagagagatgttgcagtggccataaaaaccctgaaagttggttacacagaaaagcaaaggagggactttttatgcgaagcaagcatcatggggcaatttgaccacccaaatgtcgtccatttggaaggggttgttacaagagggaagcctgtcatgattgtgatagagttcatggagaatggagccctggatgcatttctcaggaaacacgatgggcagtttacagtcattcagttggtaggaatgttgagaggtattgccgctgggatgcgatacttggctgatatgggatacgttcacagggaccttgcagcgcgcaacatccttgtcaacagcaatcttgtttgtaaagtgtcagattttggcctttcccgggttatagaggatgatcccgaagctgtctacaccacgactggtggaaaaattccagtaaggtggactgcaccggaagccattcaataccggaagttcacctcagccagcgatgtgtggagctatgggattgtcatgtgggaagtgatgtcttatggagaaagaccttactgggacatgtcaaatcaagatgtcattaaagcgatagaagaaggttatcgtttgccggcgcccatggattgcccagctggtcttcaccagctaatgctggattgttggcagaaagatcgggcggaaaggccaaagtttgagcagatagtcggaattctagacaaaatgattcgaaacccaagtagtctgaaaacacccctgggaacttgtagtagacccttaagccctcttctggaccagagcactcctgacttcactgccttctgttcagttggagaatggttgcaagctattaaaatggaaaggtataaggacaacttcacagcagcgggttacaactcactcgagtcagtggccaggatgactatcgatgatgtgatgagtttagggatcacactggttggccatcaaaagaagatcatgagcagcatccagactatgcgggcacaaatgttgcatttacacggaacaggcatccaagtgtga

SEQ ID NO: 16 - protein, 998 aa, Mus musculus
MVVQTRFPSWIILCYIWLLGFAHTGEAQAAKEVLLLDSKAQQTELEWISSPPSGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWTIVENLAVFPDTVTGSEFSSLVEVRGTCVSSAEEEAENSPRMHCSAEGEWLVPIGKCICKAGYQQKGDTCEPCGRRFYKSSSQDLQCSRCPTHSFSDREGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVQLSWQEPEHPNGVITEYEIKYYEKDQRERTYSTLKTKSTSASINNLKPGTVYVFQIRAVTAAGYGNYSPRLDVATLEEASGKMFEATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGQRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKDRAERPKFEQIVGILDKMIRNPSSLKTPLGTCSRPLSPLLDQSTPDFTAFCSVGEWLQAIKMERYKDNFTAAGYNSLESVARMTIDDVMSLGITLVGHQKKIMSSIQTMRAQMLHLHGTGIQV

SEQ ID NO: 17 - DNA, 2985 bp, Mus musculus
  CDS (1)..(2982)
atggttgttcaaactcggttcccttcgtggattattttgtgttacatctggctgcttggctttgcacacacgggggaggcgcaggctgcgaaggaagtactattactggactcgaaagcacaacaaacagaattggaatggatttcctctccacccagtgggtgggaagaaattagtggtttggatgagaactacactccgataagaacataccaggtgtgccaggtcatggagcccaaccagaacaactggctgcggactaactggatttctaaaggcaacgcacaaaggatttttgtagaattgaaattcaccttgagggattgtaatagtcttcccggagtcctgggaacttgcaaggaaacgtttaatttgtactattatgaaacagactacgacaccggcaggaatatacgagaaaacctttatgttaaaatagacaccattgctgcagatgaaagtttcacacaaggtgaccttggtgaaagaaagatgaagctgaacactgaggtgagagagattggacctttgtccaaaaagggattctatcttgcctttcaggatgtaggggcttgcatagcattggtttctgtcaaagtgtactacaagaagtgctggtccattgttgagaacttagctgtctttccagatacagtgactggttcggaattttcgtccttagtcgaggtccgtgggacatgtgtcagcagtgccgaggaagaggcagaaaattcccccaggatgcattgcagtgcagaaggagagtggctagtacccattggaaaatgcatctgcaaagcaggctatcagcaaaaaggggacacttgcgaaccctgtggccgcaggttctacaaatcttcctctcaggatctccagtgttctcgttgtccaacccacagcttctctgaccgagaaggatcatccaggtgtgaatgtgaagatgggtactacagagctccttctgatccaccatacgttgcatgcacgaggcctccctctgcaccacagaaccttattttcaacatcaatcaaacgactgtaagtttggaatggagtcctccggctgacaacgggggaagaaacgatgtcacctacagaatactgtgtaagcggtgcagttgggaacagggagaatgtgtgccatgcggaagtaacattggatacatgccccagcagacaggattagaggataactatgtcactgtcatggacctacttgcccatgcaaattacactttcgaagttgaagctgtaaatggagtttcggacttaagcagatcccagaggctcttcgctgcagttagcatcactaccggtcaagcagctccctcgcaagtgagtggagtcatgaaggagcgagtactgcagcggagtgtgcagctttcctggcaggagccggagcatcccaatggagtcatcaccgaatatgaaatcaagtattatgagaaagatcaacgggaaaggacgtactcaacactcaaaaccaagtccacctccgcctccattaataatctgaaaccgggaacagtgtatgtgtttcagatccgggcggtcactgctgccggttatggaaactacagccctaggcttgatgttgccacacttgaggaagcttcaggtaaaatgtttgaagcgacagcagtctccagtgaacagaatcctgtcatcataattgctgtagtggctgtagcagggaccatcatcttggtgttcatggtgttcggcttcatcattggaagaaggcactgtggttatagcaaggctgaccaagaaggggatgaagaactctactttcattgcaccaaaacctacattgaccctgaaacctatgaggacccaaatagagctgtccatcaattcgccaaggagctagatgcctcctgtattaaaattgagcgtgtgattggtgcaggagaatttggagaagtttgcagtggtcgtttgaaacttccggggaagagagatgttgcagtggccataaaaaccctgaaagttggttacacagaaaaacaaaggagggactttttatgcgaagcaagcatcatggggcaatttgaccacccaaatgtcgtccatttggaaggggttgttacaagagggaagcctgtcatgattgtgatagagttcatggagaatggagccctggatgcatttctcaggaaacacgatgggcagtttacagtcattcagttggtaggaatgctgagaggtattgccgctgggatgcgatacttggctgatatgggatacgttcacagggaccttgcagcacgcaacatccttgtcaacagcaatcttgtttgtaaagtgtcagattttggcctttcccgggttatagaggatgatcccgaagctgtctacaccacgactggtggaaaaattccagtaaggtggactgcaccggaagccattcaataccggaagttcacctcagccagcgatgtgtggagctatgggattgtcatgtgggaagtgatgtcttatggagaaagaccttactgggacatgtcaaatcaagatgtcattaaagcgatagaagaaggttatcgtttgccggcgcccatggattgcccagctggtcttcaccagctaatgctggattgttggcagaaagatcgggcggaaaggccaaagtttgagcagatagtcggaattctagacaaaatgattcgaaacccaagtagtctgaaaacacccctgggaacttgtagtagacccataagccctcttctggaccagagcactcctgacttcactgccttctgttcagttggagaatggttgcaagctattaaaatggaaaggtataaggacaacttcacagcagcgggttacaactcactcgagtcagtggccaggatgactatcgatgatgtgatgagtttagggatcacactggttggccatcaaaagaagatcatgagcagcatccagactatgcgggcacaaatgttgcatttacacggaacaggcatccaagtgtga

SEQ ID NO: 18 - protein, 994 aa, Mus musculus
MVVQTRFPSWIILCYIWLLGFAHTGEAQAAKEVLLLDSKAQQTELEWISSPPSGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIVENLAVFPDTVTGSEFSSLVEVRGTCVSSAEEEAENSPRMHCSAEGEWLVPIGKCICKAGYQQKGDTCEPCGRRFYKSSSQDLQCSRCPTHSFSDREGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVQLSWQEPEHPNGVITEYEIKYYEKDQRERTYSTLKTKSTSASINNLKPGTVYVFQIRAVTAAGYGNYSPRLDVATLEEASGKMFEATAVSSEQNPVIIIAVVAVAGTIILVFMVFGFIIGRRHCGYSKADQEGDEELYFHCTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKDRAERPKFEQIVGILDKMIRNPSSLKTPLGTCSRPISPLLDQSTPDFTAFCSVGEWLQAIKMERYKDNFTAAGYNSLESVARMTIDDVMSLGITLVGHQKKIMSSIQTMRAQMLHLHGTGIQV

SEQ ID NO: 19 - DNA, 1833 bp, Mus musculus
  CDS (1)..(1830)
atggttgttcaaactcggttcccttcgtggattattttgtgttacatctggctgcttggctttgcacacacgggggaggcgcaggctgcgaaggaagtactattactggactcgaaagcacaacaaacagaattggaatggatttcctctccacccagtgggtgggaagaaattagtggtttggatgagaactacactccgataagaacataccaggtgtgccaggtcatggagcccaaccagaacaactggctgcggactaactggatttctaaaggcaacgcacaaaggatttttgtagaattgaaattcaccttgagggattgtaatagtcttcccggagtcctgggaacttgcaaggaaacgtttaatttgtactattatgaaacagactacgacaccggcaggaatatacgagaaaacctttatgttaaaatagacaccattgctgcagatgaaagtttcacacaaggtgaccttggtgaaagaaagatgaagctgaacactgaggtgagagagattggacctttgtccaaaaagggattctatcttgcctttcaggatgtaggggcttgcatagcattggtttctgtcaaagtgtactacaagaagtgctggtccattgttgagaacttagctgtctttccagatacagtgactggttcggaattttcctccttagtcgaggtccgtgggacatgtgtcagcagtgccgaggaagaggcagaaaattcccccagaatgcattgcagtgcagaaggagagtggctagtacccattggaaaatgcatctgcaaagcaggctatcagcaaaaaggggacacttgcgaaccctgtggccgcaggttctacaaatcttcctctcaggatctccagtgttctcgttgtccaacccacagcttctctgaccgagaaggatcatccaggtgtgaatgtgaagatgggtactacagagctccttctgatccaccatacgttgcatgcacgaggcctccctctgcaccacagaaccttattttcaatatcaatcaaacgactgtaagtttggaatggagtcctccggctgacaacgggggaagaaacgatgtcacctacagaatactgtgtaagcggtgcagttgggaacagggagaatgtgtgccatgcggaagtaacattggatacatgccccagcagacgggattagaggataactatgtcactgtcatggacctacttgcccatgcaaattacactttcgaagttgaagctgtaaatggagtttcggacttaagcagatcccagaggctcttcgctgctgttagcatcaccaccggtcaagcagctccctcgcaagtgagtggagtcatgaaggagcgagtactgcagcggagtgtgcagctttcctggcaggagccggagcatcccaatggagtcatcacggaatatgaaatcaagtattatgagaaagatcaacgggaaaggacgtactcaacactcaaaaccaagtccacctccgcctccattaataatctgaaaccgggaacagtgtacgtctttcagatccgggcggtcactgctgccggttatggaaactacagccctaggcttgatgttgccacacttgaggaagcttcaggtaaaatgtttgaagcgacagcagtctccagtgaacagaatcctgtcatcataattgctgtagtggctgtagcagggaccatcatcttggtgttcatggtgttcggcttcatcattggaagaaggcactgtggttatagcaaggctgaccaagaaggggatgaagaactctactttcattctttagtaacaaatgagcacctgtcagttttataa

SEQ ID NO: 20 - protein, 610 aa, Mus musculus
MVVQTRFPSWIILCYIWLLGFAHTGEAQAAKEVLLLDSKAQQTELEWISSPPSGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIVENLAVFPDTVTGSEFSSLVEVRGTCVSSAEEEAENSPRMHCSAEGEWLVPIGKCICKAGYQQKGDTCEPCGRRFYKSSSQDLQCSRCPTHSFSDREGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVQLSWQEPEHPNGVITEYEIKYYEKDQRERTYSTLKTKSTSASINNLKPGTVYVFQIRAVTAAGYGNYSPRLDVATLEEASGKMFEATAVSSEQNPVIIIAVVAVAGTIILVFMVFGFIIGRRHCGYSKADQEGDEELYFHSLVTNEHLSVL

SEQ ID NO: 21 - DNA, 1881 bp, Mus musculus
  CDS (1)..(1878)
atggttgttcaaactcggttcccttcgtggattattttgtgttacatctggctgcttggctttgcacacacgggggaggcgcaggctgcgaaggaagtactattactggactcgaaagcacaacaaacagaattggaatggatttcctctccacccagtgggtgggaagaaattagtggtttggatgagaactacactccgataagaacataccaggtgtgccaggtcatggagcccaaccagaacaactggctgcggactaactggatttctaaaggcaacgcacaaaggatttttgtagaattgaaattcaccttgagggattgtaatagtcttcccggagtcctgggaacttgcaaggaaacgtttaatttgtactattatgaaacagactacgacaccggcaggaatatacgagaaaacctttatgttaaaatagacaccattgctgcagatgaaagtttcacacaaggtgaccttggtgaaagaaagatgaagctgaacactgaggtgagagagattggacctttgtccaaaaagggattctatcttgcctttcaggatgtaggggcttgcatagcattggtttctgtcaaagtgtactacaagaagtgctggaccattgttgagaacttagctgtctttccagatacagtgactggttcggaattttcctccttagtcgaggtccgtgggacatgtgtcagcagtgccgaggaagaggcagaaaattcccccagaatgcattgcagtgcagaaggagagtggctagtacccattggaaaatgcatctgcaaagcaggctatcagcaaaaaggggacacttgcgaaccctgtggccgcaggttctacaaatcttcctctcaggatctccagtgttctcgttgtccaacccacagcttctctgaccgagaaggatcatccaggtgtgaatgtgaagatgggtactacagagctccttctgatccaccatacgttgcatgcacgaggcctccctctgcaccacagaaccttattttcaatatcaatcaaacgactgtaagtttggaatggagtcctccggctgacaacgggggaagaaacgatgtcacctacagaatactgtgtaagcggtgcagttgggaacagggagaatgtgtgccatgcggaagtaacattggatacatgccccagcagacgggattagaggataactatgtcactgtcatggacctacttgcccatgcaaattacactttcgaagttgaagctgtaaatggagtttcggacttaagcagatcccagaggctcttcgctgctgttagcatcaccaccggtcaagcagctccctcgcaagtgagtggagtcatgaaggagcgagtactgcagcggagtgtgcagctttcctggcaggagccggagcatcccaatggagtcatcacggaatatgaaatcaagtattatgagaaagatcaacgggaaaggacgtactcaacactcaaaaccaagtccacctccgcctccattaataatctgaaaccgggaacagtgtacgtctttcagatccgggcggtcactgctgccggttatggaaactacagccctaggcttgatgttgccacacttgaggaagcttcaggtaaaatgtttgaagcgacagcagtctccagtgaacagaatcctgtcatcataattgctgtagtggctgtagcagggaccatcatcttggtgttcatggtgttcggcttcatcattggaagaaggcactgtggttatagcaaggctgaccaagaaggggatgaagaactctactttcattctctttacagggaaaggggagacgggatggaaaagacacagcacaataagaagtggatgattgcatcgtgctctcgtttgtag

SEQ ID NO: 22 - protein, 626 aa, Mus musculus
MVVQTRFPSWIILCYIWLLGFAHTGEAQAAKEVLLLDSKAQQTELEWISSPPSGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWTIVENLAVFPDTVTGSEFSSLVEVRGTCVSSAEEEAENSPRMHCSAEGEWLVPIGKCICKAGYQQKGDTCEPCGRRFYKSSSQDLQCSRCPTHSFSDREGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVQLSWQEPEHPNGVITEYEIKYYEKDQRERTYSTLKTKSTSASINNLKPGTVYVFQIRAVTAAGYGNYSPRLDVATLEEASGKMFEATAVSSEQNPVIIIAVVAVAGTIILVFMVFGFIIGRRHCGYSKADQEGDEELYFHSLYRERGDGMEKTQHNKKWMIASCSRL

SEQ ID NO: 23 - DNA, 1707 bp, Mus musculus
  CDS (1)..(1704)
ttcgctgctgttagcatcaccaccggtcaagcagctccctcgcaagtgagtggagtcatgaaggagcgagtactgcagcggagtgtgcagctttcctggcaggagccggagcatcccaatggagtcatcacggaatatgaaatcaagcattatgagaaagatcaacgggaaaggacgtactcaacactcaaaaccaagtccacctccgcctccattaataatctgaaaccgggaacagtgtacgtctttcagatccgggcggtcactgctgccggttatggaaactacagccctaggcttgatgttgccacacttgaggaagcttcaggtaaaatgtttgaagcgacagcagtctccagtgaacagaatcctgtcatcataattgctgtagtggctgtagcagggaccatcatcttggtgttcatggtgttcggcttcatcattggaagaaggcactgtggttatagcaaggctgaccaagaaggggatgaagaactctactttcattttaaatttccaggcaccaaaacctacattgaccctgaaacctatgaggacccaaatagagctgtccatcaattcgccaaggagctagatgcctcctgtattaaaattgagcgtgtgattggtgcaggagaatttggagaagtttgcagtggtcgtttgaaacttccggggaagagagatgttgcagtggccataaaaaccctgaaagttggttacacagaaaagcaaaggagggactttttatgcgaagcaagcatcatggggcaatttgaccacccaaatgtcgtccatttggaaggggttgttacaagagggaagcctgtcatgattgtgatagagttcatggagaatggagccctggatgcatttctcaggaaacacgatgggcagtttacagtcattcagttggtaggaatgttgagaggtattgccgctgggatgcgatacttggctgatatgggatacgttcacagggaccttgcagcgcgcaacatccttgtcaacagcaatcttgtttgtaaagtgtcagattttggcctttcccgggttatagaggatgatcccgaagctgtctacaccacgactggtggaaaaattccagtaaggtggactgcaccggaagccattcaataccggaagttcacctcagccagcgatgtgtggagctatgggattgtcatgtgggaagtgatgtcttatggagaaagaccttactgggacatgtcaaatcaagatgtcattaaagcgatagaagaaggttatcgtttgccggcgcccatggattgcccagctggtcttcaccagctaatgctggattgttggcagaaagatcgggcggaaaggccaaagtttgagcagatagtcggaattctagacaaaatgattcgaaacccaagtagtctgaaaacacccctgggaacttgtagtagacccttaagccctcttctggaccagagcactcctgacttcactgccttctgttcagttggagaatggttgcaagctattaaaatggaaaggtataaggacaacttcacagcagcgggttacaactcactcgagtcagtggccaggatgactatcgatgatgtgatgagtttagggatcacactggttggccatcaaaagaagatcatgagcagcatccagactatgcgggcacaaatgttgcatttacacggaacaggcatccaagtgtga

SEQ ID NO: 24 - protein, 568 aa, Mus musculus
FAAVSITTGQAAPSQVSGVMKERVLQRSVQLSWQEPEHPNGVITEYEIKHYEKDQRERTYSTLKTKSTSASINNLKPGTVYVFQIRAVTAAGYGNYSPRLDVATLEEASGKMFEATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKDRAERPKFEQIVGILDKMIRNPSSLKTPLGTCSRPLSPLLDQSTPDFTAFCSVGEWLQAIKMERYKDNFTAAGYNSLESVARMTIDDVMSLGITLVGHQKKIMSSIQTMRAQMLHLHGTGIQV

SEQ ID NO: 25 - DNA, 2997 bp, Canis familiaris
  CDS (1)..(2997)
atggtttttcaaactcggcacccttcgtggattattttgtgctacatctggctgctccgctttgcacacaccggggaggcgcaggctgccaaggaagtactactgctggattctaaagcacaacaaacagagttggaatggatttcctctccccccaacgggtgggaagaaatcagtggtttggatgagaactacaccccaatacgaacgtaccaggtgtgccaggtcatggaacccaaccaaaacaactggctgcggactaactggatttcgaaaggcaacgcacagaggatttttgtagaattgaaatttaccctgagggattgtaacagtcttcctggagtcctgggaacttgcaaggaaacctttaatttgtactattatgaaacagactacgacactggcaggaatataagagaaaatctctatgtaaaaatagacaccattgctgctgatgaaagttttacccaaggtgaccttggtgaaagaaagatgaagcttaacactgaggtgagagagattggacctttgtccaaaaagggattctatcttgcctttcaggatgtaggggcttgcatagctttggtttctgtcaaagtatactacaagaagtgctggtccattattgagaatttagctatctttccagatacagtgactggttcagaattttcctctttagtcgaggttcgagggacatgtgtcagcagtgcagaggaagaggcggaaaactcccccaggatgcactgcagtgcagaaggagaatggttagtgcccattggaaagtgtatctgcaaagcaggctaccagcaaaaaggggacacttgtgaaccctgtggccgtgggttctacaaatcttcctctcaagatcttcagtgcgctcgttgtccaactcacagtttttctgataaagaaggctcctcaagatgtgaatgtgaggatgggtattacagggctccatctgatccaccgtatgttgcctgcacaaggcctccatctgcgccacagaacctcattttcaacatcaaccaaaccacagtaagtttggaatggagtcctcctgcagataatggaggaagaaatgatgtgacctacagaatattgtgtaagcggtgcagttgggaacagggcgaatgtgttccctgtgggagtaacattggatacatgccacagcagactggattagaggataactatgtcactgtcatggacctgctagcccacgctaattatacttttgaagtggaagctgtcaatggagtttctgacttaagccgatcccagaggctctttgcggctgtcagtatcaccactggtcaagcagctccctcgcaagtgagcggagtgatgaaggagagggtgctgcagcggagtgtcgagctttcctggcaggaaccagagcatcccaatggagtcatcaccgaatatgaaatcaagtattacgagaaagatcaaagggaacggacctattcgacagtaaaaaccaagtccacttcagcttccattaataacctgaagccaggaacagtgtatgttttccagattcgggcttttactgctgctggttatggaaattacagccccagacttgacgttgctacactagaggaagctacaggtaaaatgtttgaagcgacagccgtctccagtgaacagaatcctgttattataattgccgtggttgcagtggcagggaccatcattttggtgttcatggtctttggcttcatcattggaagaaggcactgtggttatagcaaagctgaccaagaaggggatgaagagctttactttcattttaaatttccaggcaccaaaacctacattgaccctgaaacctatgaggacccaaatagagctgtccatcaattcgccaaggagctagatgcctcctgtattaaaattgagcgtgtgattggtgcaggagaatttggagaagtctgcagtggtcgtttgaaacttccagggaaaagagatgttgcagtagccataaaaaccctcaaagttggttacacagaaaaacaaaggagagactttttatgtgaagccagcatcatggggcagtttgaccacccgaatgttgtccatttggaaggggtggttacaagagggaaaccagtcatgatagtaatagaattcatggaaaatggagcccttgatgcatttctcaggaaacacgatgggcaatttaccgtcattcagttagtaggaatgctgagaggaattgctgctggaatgagatatttggctgatatgggatacgttcacagggaccttgcagctcgcaatattcttgtcaacagcaatcttgtttgtaaagtgtcagatttcggcctgtcccgggttatagaggacgatccagaagctgtctatacaacaactggcggaaaaattccagtaaggtggacagcacctgaagccatccaataccggaaattcacatcagccagtgacgtatggagctatggaatagtcatgtgggaagttatgtcttatggagaaagaccttattgggacatgtcaaatcaagatgttataaaagcgatagaagaaggttatcgtttaccagcacccatggactgtccggctggtcttcaccagttgatgctggattgttggcaaaaggaacgtgcagaaaggccaaagtttgaacagatagttggaattctagacaaaatgattcgaaacccaaatagtctgaaaacacccctgggaacttgtagtaggccaataagtcctcttttggatcaaaacactcctgacttcactaccttttgttcagttggagaatggctacaagctattaagatggaaagatataaagataacttcacagcagctggttacaactcccttgaatcagtggccaggatgactattgaagatgtgatgagtttagggatcacactggttggccaccaaaagaaaatcatgagcagcattcagactatgagagcacaaatgctacatttacatggaactggcatccaagtgtga

SEQ ID NO: 26 - protein, 998 aa, Canis familiaris
MVFQTRHPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENSPRMHCSAEGEWLVPIGKCICKAGYQQKGDTCEPCGRGFYKSSSQDLQCARCPTHSFSDKEGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSASINNLKPGTVYVFQIRAFTAAGYGNYSPRLDVATLEEATGKMFEATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPNSLKTPLGTCSRPISPLLDQNTPDFTTFCSVGEWLQAIKMERYKDNFTAAGYNSLESVARMTIEDVMSLGITLVGHQKKIMSSIQTMRAQMLHLHGTGIQV

SEQ ID NO: 27 - DNA, 2877 bp, Canis familiaris
  CDS (1)..(2874)
atggtttttcaaactcggcacccttcgtggattattttgtgctacatctggctgctccgctttgcacacaccggggaggcgcaggctgccaaggaagtactactgctggattctaaagcacaacaaacagagttggaatggatttcctctccccccaacgggtgggaagaaatcagtggtttggatgagaactacaccccaatacgaacgtaccaggtgtgccaggtcatggaacccaaccaaaacaactggctgcggactaactggatttcgaaaggcaacgcacagaggatttttgtagaattgaaatttaccctgagggattgtaacagtcttcctggagtcctgggaacttgcaaggaaacctttaatttgtactattatgaaacagactacgacactggcaggaatataagagaaaatctctatgtaaaaatagacaccattgctgctgatgaaagttttacccaaggtgaccttggtgaaagaaagatgaagcttaacactgaggtgagagagattggacctttgtccaaaaagggattctatcttgcctttcaggatgtaggggcttgcatagctttggtttctgtcaaagtatactacaagaagtgctggtccattattgagaatttagctatctttccagatacagtgactggttcagaattttcctctttagtcgaggttcgagggacatgtgtcagcagtgcagaggaagaggcggaaaactcccccaggatgcactgcagtgcagaaggagaatggttagtgcccattggaaagtgtatctgcaaagcaggctaccagcaaaaaggggacacttgtgaaccctgtggccgtgggttctacaaatcttcctctcaagatcttcagtgcgctcgttgtccaactcacagtttttctgataaagaaggctcctcaagatgtgaatgtgaggatgggtattacagggctccatctgatccaccgtatgttgcctgcacaaggcctccatctgcgccacagaacctcattttcaacatcaaccaaaccacagtaagtttggaatggagtcctcctgcagataatggaggaagaaatgatgtgacctacagaatattgtgtaagcggtgcagttgggaacagggcgaatgtgttccctgtgggagtaacattggatacatgccacagcagactggattagaggataactatgtcactgtcatggacctgctagcccacgctaattatacttttgaagtggaagctgtcaatggagtttctgacttaagccgatcccagaggctctttgcggctgtcagtatcaccactggtcaagcagctccctcgcaagtgagcggagtgatgaaggagagggtgctgcagcggagtgtcgagctttcctggcaggaaccagagcatcccaatggagtcatcaccgaatatgaaatcaagtattacgagaaagatcaaagggaacggacctattcgacagtaaaaaccaagtccacttcagcttccattaataacctgaagccaggaacagtgtatgttttccagattcgggcttttactgctgctggttatggaaattacagccccagacttgacgttgctacactagaggaagctacagtgcatggcccaatgctatcggatgaacagaatcctgttattataattgccgtggttgcagtggcagggaccatcattttggtgttcatggtctttggcttcatcattggaagaaggcactgtggttatagcaaagctgaccaagaaggggatgaagagctttactttcattttaaatttccaggcaccaaaacctacattgaccctgaaacctatgaggacccaaatagagctgtccatcaattcgccaaggagctagatgcctcctgtattaaaattgagcgtgtgattggtgcaggagaatttggagaagtctgcagtggtcgtttgaaacttccagggaaaagagatgttgcagtagccataaaaaccctcaaagttggttacacagaaaaacaaaggagagactttttatgtgaagccagcatcatggggcagtttgaccacccgaatgttgtccatttggaaggggtggttacaagagggaaaccagtcatgatagtaatagaattcatggaaaatggagcccttgatgcatttctcaggaaacacgatgggcaatttaccgtcattcagttagtaggaatgctgagaggaattgctgctggaatgagatatttggctgatatgggatacgttcacagggaccttgcagctcgcaatattcttgtcaacagcaatcttgtttgtaaagtgtcagatttcggcctgtcccgggttatagaggacgatccagaagctgtctatacaacaactggcggaaaaattccagtaaggtggacagcacctgaagccatccaataccggaaattcacatcagccagtgacgtatggagctatggaatagtcatgtgggaagttatgtcttatggagaaagaccttattgggacatgtcaaatcaagatgttataaaagcgatagaagaaggttatcgtttaccagcacccatggactgtccggctggtcttcaccagttgatgctggattgttggcaaaaggaacgtgcagaaaggccaaagtttgaacagatagttggaattctagacaaaatgattcgaaacccaaatagtctgaaaacacccctgggaacttgtagtaggccaataagtcctcttttggatcaaaacactcctgacttcactaccttttgttcagttggagaatggctacaagctattaagatggaaagatataaagataacttcacagcagctggttacaactcccttgaatcagtggccaggatgactattgagtaa

SEQ ID NO: 28 - protein, 958 aa, Canis familiaris
MVFQTRHPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENSPRMHCSAEGEWLVPIGKCICKAGYQQKGDTCEPCGRGFYKSSSQDLQCARCPTHSFSDKEGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSASINNLKPGTVYVFQIRAFTAAGYGNYSPRLDVATLEEATVHGPMLSDEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPNSLKTPLGTCSRPISPLLDQNTPDFTTFCSVGEWLQAIKMERYKDNFTAAGYNSLESVARMTIE

SEQ ID NO: 29 - DNA, 2958 bp, Canis familiaris
  CDS (1)..(2955)
atggtttttcaaactcggcacccttcgtggattattttgtgctacatctggctgctccgctttgcacacaccggggaggcgcaggctgccaaggaagtactactgctggattctaaagcacaacaaacagagttggaatggatttcctctccccccaacgggtgggaagaaatcagtggtttggatgagaactacaccccaatacgaacgtaccaggtgtgccaggtcatggaacccaaccaaaacaactggctgcggactaactggatttcgaaaggcaacgcacagaggatttttgtagaattgaaatttaccctgagggattgtaacagtcttcctggagtcctgggaacttgcaaggaaacctttaatttgtactattatgaaacagactacgacactggcaggaatataagagaaaatctctatgtaaaaatagacaccattgctgctgatgaaagttttacccaaggtgaccttggtgaaagaaagatgaagcttaacactgaggtgagagagattggacctttgtccaaaaagggattctatcttgcctttcaggatgtaggggcttgcatagctttggtttctgtcaaagtatactacaagaagtgctggtccattattgagaatttagctatctttccagatacagtgactggttcagaattttcctctttagtcgaggttcgagggacatgtgtcagcagtgcagaggaagaggcggaaaactcccccaggatgcactgcagtgcagaaggagaatggttagtgcccattggaaagtgtatctgcaaagcaggctaccagcaaaaaggggacacttgtgaaccctgtggccgtgggttctacaaatcttcctctcaagatcttcagtgcgctcgttgtccaactcacagtttttctgataaagaaggctcctcaagatgtgaatgtgaggatgggtattacagggctccatctgatccaccgtatgttgcctgcacaaggcctccatctgcgccacagaacctcattttcaacatcaaccaaaccacagtaagtttggaatggagtcctcctgcagataatggaggaagaaatgatgtgacctacagaatattgtgtaagcggtgcagttgggaacagggcgaatgtgttccctgtgggagtaacattggatacatgccacagcagactggattagaggataactatgtcactgtcatggacctgctagcccacgctaattatacttttgaagtggaagctgtcaatggagtttctgacttaagccgatcccagaggctctttgcggctgtcagtatcaccactggtcaagcagctccctcgcaagtgagcggagtgatgaaggagagggtgctgcagcggagtgtcgagctttcctggcaggaaccagagcatcccaatggagtcatcaccgaatatgaaatcaagtattacgagaaagatcaaagggaacggacctattcgacagtaaaaaccaagtccacttcagcttccattaataacctgaagccaggaacagtgtatgttttccagattcgggcttttactgctgctggttatggaaattacagccccagacttgacgttgctacactagaggaagctacaggtaaaatgtttgaagcgacagccgtctccagtgaacagaatcctgttattataattgccgtggttgcagtggcagggaccatcattttggtgttcatggtctttggcttcatcattggaagaaggcactgtggttatagcaaagctgaccaagaaggggatgaagagctttactttcattttaaatttccaggcaccaaaacctacattgaccctgaaacctatgaggacccaaatagagctgtccatcaattcgccaaggagctagatgcctcctgtattaaaattgagcgtgtgattggtgcaggagaatttggagaagtctgcagtggtcgtttgaaacttccagggaaaagagatgttgcagtagccataaaaaccctcaaagttggttacacagaaaaacaaaggagagactttttatgtgaagccagcatcatggggcagtttgaccacccgaatgttgtccatttggaaggggtggttacaagagggaaaccagtcatgatagtaatagaattcatggaaaatggagcccttgatgcatttctcaggaaacacgatgggcaatttaccgtcattcagttagtaggaatgctgagaggaattgctgctggaatgagatatttggctgatatgggatacgttcacagggaccttgcagctcgcaatattcttgtcaacagcaatcttgtttgtaaagtgtcagatttcggcctgtcccggggcggaaaaattccagtaaggtggacagcacctgaagccatccaataccggaaattcacatcagccagtgacgtatggagctatggaatagtcatgtgggaagttatgtcttatggagaaagaccttattgggacatgtcaaatcaagatgttataaaagcgatagaagaaggttatcgtttaccagcacccatggactgtccggctggtcttcaccagttgatgctggattgttggcaaaaggaacgtgcagaaaggccaaagtttgaacagatagttggaattctagacaaaatgattcgaaacccaaatagtctgaaaacacccctgggaacttgtagtaggccaataagtcctcttttggatcaaaacactcctgacttcactaccttttgttcagttggagaatggctacaagctattaagatggaaagatataaagataacttcacagcagctggttacaactcccttgaatcagtggccaggatgactattgaagatgtgatgagtttagggatcacactggttggccaccaaaagaaaatcatgagcagcattcagactatgagagcacaaatgctacatttacatggaactggcatccaagtgtga

SEQ ID NO: 30 - protein, 985 aa, Canis familiaris
MVFQTRHPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENSPRMHCSAEGEWLVPIGKCICKAGYQQKGDTCEPCGRGFYKSSSQDLQCARCPTHSFSDKEGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSASINNLKPGTVYVFQIRAFTAAGYGNYSPRLDVATLEEATGKMFEATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPNSLKTPLGTCSRPISPLLDQNTPDFTTFCSVGEWLQAIKMERYKDNFTAAGYNSLESVARMTIEDVMSLGITLVGHQKKIMSSIQTMRAQMLHLHGTGIQV

SEQ ID NO: 31 - DNA, 3033 bp, Canis familiaris
  CDS (1)..(3030)
atggtttttcaaactcggcacccttcgtggattattttgtgctacatctggctgctccgctttgcacacaccggggaggcgcaggctgccaaggaagtactactgctggattctaaagcacaacaaacagagttggaatggatttcctctccccccaacgggtgggaagaaatcagtggtttggatgagaactacaccccaatacgaacgtaccaggtgtgccaggtcatggaacccaaccaaaacaactggctgcggactaactggatttcgaaaggcaacgcacagaggatttttgtagaattgaaatttaccctgagggattgtaacagtcttcctggagtcctgggaacttgcaaggaaacctttaatttgtactattatgaaacagactacgacactggcaggaatataagagaaaatctctatgtaaaaatagacaccattgctgctgatgaaagttttacccaaggtgaccttggtgaaagaaagatgaagcttaacactgaggtgagagagattggacctttgtccaaaaagggattctatcttgcctttcaggatgtaggggcttgcatagctttggtttctgtcaaagtatactacaagaagtgctggtccattattgagaatttagctatctttccagatacagtgactggttcagaattttcctctttagtcgaggttcgagggacatgtgtcagcagtgcagaggaagaggcggaaaactcccccaggatgcactgcagtgcagaaggagaatggttagtgcccattggaaagtgtatctgcaaagcaggctaccagcaaaaaggggacacttgtgaaccctgtggccgtgggttctacaaatcttcctctcaagatcttcagtgcgctcgttgtccaactcacagtttttctgataaagaaggctcctcaagatgtgaatgtgaggatgggtattacagggctccatctgatccaccgtatgttgcctgcacaaggcctccatctgcgccacagaacctcattttcaacatcaaccaaaccacagtaagtttggaatggagtcctcctgcagataatggaggaagaaatgatgtgacctacagaatattgtgtaagcggtgcagttgggaacagggcgaatgtgttccctgtgggagtaacattggatacatgccacagcagactggattagaggataactatgtcactgtcatggacctgctagcccacgctaattatacttttgaagtggaagctgtcaatggagtttctgacttaagccgatcccagaggctctttgcggctgtcagtatcaccactggtcaagcagctccctcgcaagtgagcggagtgatgaaggagagggtgctgcagcggagtgtcgagctttcctggcaggaaccagagcatcccaatggagtcatcaccgaatatgaaatcaagtattacgagaaagatcaaagggaacggacctattcgacagtaaaaaccaagtccacttcagcttccattaataacctgaagccaggaacagtgtatgttttccagattcgggcttttactgctgctggttatggaaattacagccccagacttgacgttgctacactagaggaagctacaggtaaaatgtttgaagcgacagccgtctccagtgaacagaatcctgttattataattgccgtggttgcagtggcagggaccatcattttggtgttcatggtctttggcttcatcattggaagaaggcactgtggttatagcaaagctgaccaagaaggggatgaagagctttactttcattttaaatttccaggcaccaaaacctacattgaccctgaaacctatgaggacccaaatagagctgtccatcaattcgccaaggagctagatgcctcctgtattaaaattgagcgtgtgattggtgcaggagaatttggagaagtctgcagtggtcgtttgaaacttccagggaaaagagatgttgcagtagccataaaaaccctcaaagttggttacacagaaaaacaaaggagagactttttatgtgaagccagcatcatggggcagtttgaccacccgaatgttgtccatttggaaggggtggttacaagagggaaaccagtcatgatagtaatagaattcatggaaaatggagcccttgatgcatttctcagggtaagtaacaaaacccctgcttctccctctgcctgtaaacacgatgggcaatttaccgtcattcagttagtaggaatgctgagaggaattgctgctggaatgagatatttggctgatatgggatacgttcacagggaccttgcagctcgcaatattcttgtcaacagcaatcttgtttgtaaagtgtcagatttcggcctgtcccgggttatagaggacgatccagaagctgtctatacaacaactggcggaaaaattccagtaaggtggacagcacctgaagccatccaataccggaaattcacatcagccagtgacgtatggagctatggaatagtcatgtgggaagttatgtcttatggagaaagaccttattgggacatgtcaaatcaagatgttataaaagcgatagaagaaggttatcgtttaccagcacccatggactgtccggctggtcttcaccagttgatgctggattgttggcaaaaggaacgtgcagaaaggccaaagtttgaacagatagttggaattctagacaaaatgattcgaaacccaaatagtctgaaaacacccctgggaacttgtagtaggccaataagtcctcttttggatcaaaacactcctgacttcactaccttttgttcagttggagaatggctacaagctattaagatggaaagatataaagataacttcacagcagctggttacaactcccttgaatcagtggccaggatgactattgaagatgtgatgagtttagggatcacactggttggccaccaaaagaaaatcatgagcagcattcagactatgagagcacaaatgctacatttacatggaactggcatccaagtgtga

SEQ ID NO: 32 - protein, 1010 aa, Canis familiaris
MVFQTRHPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENSPRMHCSAEGEWLVPIGKCICKAGYQQKGDTCEPCGRGFYKSSSQDLQCARCPTHSFSDKEGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSASINNLKPGTVYVFQIRAFTAAGYGNYSPRLDVATLEEATGKMFEATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRVSNKTPASPSACKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPNSLKTPLGTCSRPISPLLDQNTPDFTTFCSVGEWLQAIKMERYKDNFTAAGYNSLESVARMTIEDVMSLGITLVGHQKKIMSSIQTMRAQMLHLHGTGIQV

SEQ ID NO: 33 - DNA, 3129 bp, Canis familiaris
  CDS (1)..(3126)
atggtttttcaaactcggcacccttcgtggattattttgtgctacatctggctgctccgctttgcacacaccggggaggcgcaggctgccaaggaagtactactgctggattctaaagcacaacaaacagagttggaatggatttcctctccccccaacgggtgggaagaaatcagtggtttggatgagaactacaccccaatacgaacgtaccaggtgtgccaggtcatggaacccaaccaaaacaactggctgcggactaactggatttcgaaaggcaacgcacagaggatttttgtagaattgaaatttaccctgagggattgtaacagtcttcctggagtcctgggaacttgcaaggaaacctttaatttgtactattatgaaacagactacgacactggcaggaatataagagaaaatctctatgtaaaaatagacaccattgctgctgatgaaagttttacccaaggtgaccttggtgaaagaaagatgaagcttaacactgaggtgagagagattggacctttgtccaaaaagggattctatcttgcctttcaggatgtaggggcttgcatagctttggtttctgtcaaagtatactacaagaagtgctggtccattattgagaatttagctatctttccagatacagtgactggttcagaattttcctctttagtcgaggttcgagggacatgtgtcagcagtgcagaggaagaggcggaaaactcccccaggatgcactgcagtgcagaaggagaatggttagtgcccattggaaagtgtatctgcaaagcaggctaccagcaaaaaggggacacttgtgaaccctgtggccgtgggttctacaaatcttcctctcaagatcttcagtgcgctcgttgtccaactcacagtttttctgataaagaaggctcctcaagatgtgaatgtgaggatgggtattacagggctccatctgatccaccgtatgttgcctgcacaaggcctccatctgcgccacagaacctcattttcaacatcaaccaaaccacagtaagtttggaatggagtcctcctgcagataatggaggaagaaatgatgtgacctacagaatattgtgtaagcggtgcagttgggaacagggcgaatgtgttccctgtgggagtaacattggatacatgccacagcagactggattagaggataactatgtcactgtcatggacctgctagcccacgctaattatacttttgaagtggaagctgtcaatggagtttctgacttaagccgatcccagaggctctttgcggctgtcagtatcaccactggtcaagcagctccctcgcaagtgagcggagtgatgaaggagagggtgctgcagcggagtgtcgagctttcctggcaggaaccagagcatcccaatggagtcatcaccgaatatgaaatcaagtattacgagaaagatcaaagggaacggacctattcgacagtaaaaaccaagtccacttcagcttccattaataacctgaagccaggaacagtgtatgttttccagattcgggcttttactgctgctggttatggaaattacagccccagacttgacgttgctacactagaggaagctacaggtaaaatgtttgaagcgacagccgtctccagtgaacagaatcctgttattataattgccgtggttgcagtggcagggaccatcattttggtgttcatggtctttggcttcatcattggaagaaggcactgtggttatagcaaagctgaccaagaaggggatgaagagctttactttcattttaaatttccaggcaccaaaacctacattgaccctgaaacctatgaggacccaaatagagctgtccatcaattcgccaaggagctagatgcctcctgtattaaaattgagcgtgtgattggtgcaggagaatttggagaagtctgcagtggtcgtttgaaacttccagggaaaagagatgttgcagtagccataaaaaccctcaaagttggttacacagaaaaacaaaggagagactttttatgtgaagccagcatcatggggcagtttgaccacccgaatgttgtccatttggaaggggtggttacaagagtaccatgtattttatccagggtgataatgggaatatgcctgaagtctaggttatggttcctcaagcaatgcttttttccttatgtatacatatatatatatatatgtgtgtgtgcatttcttttaattttagggaaaccagtcatgatagtaatagaattcatggaaaatggagcccttgatgcatttctcaggaaacacgatgggcaatttaccgtcattcagttagtaggaatgctgagaggaattgctgctggaatgagatatttggctgatatgggatacgttcacagggaccttgcagctcgcaatattcttgtcaacagcaatcttgtttgtaaagtgtcagatttcggcctgtcccgggttatagaggacgatccagaagctgtctatacaacaactggcggaaaaattccagtaaggtggacagcacctgaagccatccaataccggaaattcacatcagccagtgacgtatggagctatggaatagtcatgtgggaagttatgtcttatggagaaagaccttattgggacatgtcaaatcaagatgttataaaagcgatagaagaaggttatcgtttaccagcacccatggactgtccggctggtcttcaccagttgatgctggattgttggcaaaaggaacgtgcagaaaggccaaagtttgaacagatagttggaattctagacaaaatgattcgaaacccaaatagtctgaaaacacccctgggaacttgtagtaggccaataagtcctcttttggatcaaaacactcctgacttcactaccttttgttcagttggagaatggctacaagctattaagatggaaagatataaagataacttcacagcagctggttacaactcccttgaatcagtggccaggatgactattgaagatgtgatgagtttagggatcacactggttggccaccaaaagaaaatcatgagcagcattcagactatgagagcacaaatgctacatttacatggaactggcatccaagtgtga

SEQ ID NO: 34 - protein, 1042 aa, Canis familiaris
MVFQTRHPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENSPRMHCSAEGEWLVPIGKCICKAGYQQKGDTCEPCGRGFYKSSSQDLQCARCPTHSFSDKEGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSASINNLKPGTVYVFQIRAFTAAGYGNYSPRLDVATLEEATGKMFEATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRVPCILSRVIMGICLKSRLWFLKQCFFPYVYIYIYICVCAFLLILGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPNSLKTPLGTCSRPISPLLDQNTPDFTTFCSVGEWLQAIKMERYKDNFTAAGYNSLESVARMTIEDVMSLGITLVGHQKKIMSSIQTMRAQMLHLHGTGIQV

SEQ ID NO: 35 - DNA, 3102 bp, Canis familiaris
  CDS (1)..(3099)
atggtttttcaaactcggcacccttcgtggattattttgtgctacatctggctgctccgctttgcacacaccggggaggcgcaggctgccaaggaagtactactgctggattctaaagcacaacaaacagagttggaatggatttcctctccccccaacgggtgggaagaaatcagtggtttggatgagaactacaccccaatacgaacgtaccaggtgtgccaggtcatggaacccaaccaaaacaactggctgcggactaactggatttcgaaaggcaacgcacagaggatttttgtagaattgaaatttaccctgagggattgtaacagtcttcctggagtcctgggaacttgcaaggaaacctttaatttgtactattatgaaacagactacgacactggcaggaatataagagaaaatctctatgtaaaaatagacaccattgctgctgatgaaagttttacccaaggtgaccttggtgaaagaaagatgaagcttaacactgaggtgagagagattggacctttgtccaaaaagggattctatcttgcctttcaggatgtaggggcttgcatagctttggtttctgtcaaagtatactacaagaagtgctggtccattattgagaatttagctatctttccagatacagtgactggttcagaattttcctctttagtcgaggttcgagggacatgtgtcagcagtgcagaggaagaggcggaaaactcccccaggatgcactgcagtgcagaaggagaatggttagtgcccattggaaagtgtatctgcaaagcaggctaccagcaaaaaggggacacttgtgaacaacatgacaaaattaaccaacccatccttgccttcactaatagatctcttttttcctgcataacattcagaaggaacttttgcacagcaaaggatacagtcaacaaaactcaaagacaacctacagaatgggagaagatatttagcatctgttacttccttcccaaacttttttaccacccagtcccaactaaaggcagattggcttccgaggacacctgtggccgtgggttctacaaatcttcctctcaagatcttcagtgcgctcgttgtccaactcacagtttttctgataaagaaggctcctcaagatgtgaatgtgaggatgggtattacagggctccatctgatccaccgtatgttgcctgcacaaggcctccatctgcgccacagaacctcattttcaacatcaaccaaaccacagtaagtttggaatggagtcctcctgcagataatggaggaagaaatgatgtgacctacagaatattgtgtaagcggtgcagttgggaacagggcgaatgtgttccctgtgggagtaacattggatacatgccacagcagactggattagaggataactatgtcactgtcatggacctgctagcccacgctaattatacttttgaagtggaagctgtcaatggagtttctgacttaagccgatcccagaggctctttgcggctgtcagtatcaccactggtcaagcagctccctcgcaagtgagcggagtgatgaaggagagggtgctgcagcggagtgtcgagctttcctggcaggaaccagagcatcccaatggagtcatcaccgaatatgaaatcaagtattacgagaaagatcaaagggaacggacctattcgacagtaaaaaccaagtccacttcagcttccattaataacctgaagccaggaacagtgtatgttttccagattcgggcttttactgctgctggttatggaaattacagccccagacttgacgttgctacactagaggaagctacaggtaaaatgtttgaagcgacagccgtctccagtgaacagaatcctgttattataattgccgtggttgcagtggcagggaccatcattttggtgttcatggtctttggcttcatcattggaagaaggcactgtggttatagcaaagctgaccaagaaggggatgaagagctttactttcattttaaatttccaggcaccaaaacctacattgaccctgaaacctatgaggacccaaatagagctgtccatcaattcgccaaggagctagatgcctcctgtattaaaattgagcgtgtgattggtgcaggagaatttggagaagtctgcagtggtcgtttgaaacttccagggaaaagagatgttgcagtagccataaaaaccctcaaagttggttacacagaaaaacaaaggagagactttttatgtgaagccagcatcatggggcagtttgaccacccgaatgttgtccatttggaaggggtggttacaagagggaaaccagtcatgatagtaatagaattcatggaaaatggagcccttgatgcatttctcaggaaacacgatgggcaatttaccgtcattcagttagtaggaatgctgagaggaattgctgctggaatgagatatttggctgatatgggatacgttcacagggaccttgcagctcgcaatattcttgtcaacagcaatcttgtttgtaaagtgtcagatttcggcctgtcccgggttatagaggacgatccagaagctgtctatacaacaactggcggaaaaattccagtaaggtggacagcacctgaagccatccaataccggaaattcacatcagccagtgacgtatggagctatggaatagtcatgtgggaagttatgtcttatggagaaagaccttattgggacatgtcaaatcaagatgttataaaagcgatagaagaaggttatcgtttaccagcacccatggactgtccggctggtcttcaccagttgatgctggattgttggcaaaaggaacgtgcagaaaggccaaagtttgaacagatagttggaattctagacaaaatgattcgaaacccaaatagtctgaaaacacccctgggaacttgtagtaggccaataagtcctcttttggatcaaaacactcctgacttcactaccttttgttcagttggagaatggctacaagctattaagatggaaagatataaagataacttcacagcagctggttacaactcccttgaatcagtggccaggatgactattgagtaa

SEQ ID NO: 36 - protein, 1033 aa, Canis familiaris
MVFQTRHPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENSPRMHCSAEGEWLVPIGKCICKAGYQQKGDTCEQHDKINQPILAFTNRSLFSCITFRRNFCTAKDTVNKTQRQPTEWEKIFSICYFLPKLFYHPVPTKGRLASEDTCGRGFYKSSSQDLQCARCPTHSFSDKEGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSASINNLKPGTVYVFQIRAFTAAGYGNYSPRLDVATLEEATGKMFEATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPNSLKTPLGTCSRPISPLLDQNTPDFTTFCSVGEWLQAIKMERYKDNFTAAGYNSLESVARMTIE

SEQ ID NO: 37 - DNA, 2757 bp, Canis familiaris
  CDS (1)..(2754)
atggtttttcaaactcggcacccttcgtggattattttgtgctacatctggctgctccgctttgcacacaccggggaggcgcaggctgccaaggaagtactactgctggattctaaagcacaacaaacagagttggaatggatttcctctccccccaacgggtgggaagaaatcagtggtttggatgagaactacaccccaatacgaacgtaccaggtgtgccaggtcatggaacccaaccaaaacaactggctgcggactaactggatttcgaaaggcaacgcacagaggatttttgtagaattgaaatttaccctgagggattgtaacagtcttcctggagtcctgggaacttgcaaggaaacctttaatttgtactattatgaaacagactacgacactggcaggaatataagagaaaatctctatgtaaaaatagacaccattgctgctgatgaaagttttacccaaggtgaccttggtgaaagaaagatgaagcttaacactgaggtgagagagattggacctttgtccaaaaagggattctatcttgcctttcaggatgtaggggcttgcatagctttggtttctgtcaaagtatactacaagaagtgctggtccattattgagaatttagctatctttccagatacagtgactggttcagaattttcctctttagtcgaggttcgagggacatgtgtcagcagtgcagaggaagaggcggaaaactcccccaggatgcactgcagtgcagaaggagaatggttagtgcccattggaaagtgtatctgcaaagcaggctaccagcaaaaaggggacacttgtgaaccacacactataacccacacgagattgtggcctccatctgcgccacagaacctcattttcaacatcaaccaaaccacagtaagtttggaatggagtcctcctgcagataatggaggaagaaatgatgtgacctacagaatattgtgtaagcggtgcagttgggaacagggcgaatgtgttccctgtgggagtaacattggatacatgccacagcagactggattagaggataactatgtcactgtcatggacctgctagcccacgctaattatacttttgaagtggaagctgtcaatggagtttctgacttaagccgatcccagaggctctttgcggctgtcagtatcaccactggtcaagcagctccctcgcaagtgagcggagtgatgaaggagagggtgctgcagcggagtgtcgagctttcctggcaggaaccagagcatcccaatggagtcatcaccgaatatgaaatcaagtattacgagaaagatcaaagggaacggacctattcgacagtaaaaaccaagtccacttcagcttccattaataacctgaagccaggaacagtgtatgttttccagattcgggcttttactgctgctggttatggaaattacagccccagacttgacgttgctacactagaggaagctacaggtaaaatgtttgaagcgacagccgtctccagtgaacagaatcctgttattataattgccgtggttgcagtggcagggaccatcattttggtgttcatggtctttggcttcatcattggaagaaggcactgtggttatagcaaagctgaccaagaaggggatgaagagctttactttcattttaaatttccaggcaccaaaacctacattgaccctgaaacctatgaggacccaaatagagctgtccatcaattcgccaaggagctagatgcctcctgtattaaaattgagcgtgtgattggtgcaggagaatttggagaagtctgcagtggtcgtttgaaacttccagggaaaagagatgttgcagtagccataaaaaccctcaaagttggttacacagaaaaacaaaggagagactttttatgtgaagccagcatcatggggcagtttgaccacccgaatgttgtccatttggaaggggtggttacaagagggaaaccagtcatgatagtaatagaattcatggaaaatggagcccttgatgcatttctcaggaaacacgatgggcaatttaccgtcattcagttagtaggaatgctgagaggaattgctgctggaatgagatatttggctgatatgggatacgttcacagggaccttgcagctcgcaatattcttgtcaacagcaatcttgtttgtaaagtgtcagatttcggcctgtcccgggttatagaggacgatccagaagctgtctatacaacaactggcggaaaaattccagtaaggtggacagcacctgaagccatccaataccggaaattcacatcagccagtgacgtatggagctatggaatagtcatgtgggaagttatgtcttatggagaaagaccttattgggacatgtcaaatcaagatgttataaaagcgatagaagaaggttatcgtttaccagcacccatggactgtccggctggtcttcaccagttgatgctggattgttggcaaaaggaacgtgcagaaaggccaaagtttgaacagatagttggaattctagacaaaatgattcgaaacccaaatagtctgaaaacacccctgggaacttgtagtaggccaataagtcctcttttggatcaaaacactcctgacttcactaccttttgttcagttggagaatggctacaagctattaagatggaaagatataaagataacttcacagcagctggttacaactcccttgaatcagtggccaggatgactattgagtaa

SEQ ID NO: 38 - protein, 918 aa, Canis familiaris
MVFQTRHPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENSPRMHCSAEGEWLVPIGKCICKAGYQQKGDTCEPHTITHTRLWPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSASINNLKPGTVYVFQIRAFTAAGYGNYSPRLDVATLEEATGKMFEATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPNSLKTPLGTCSRPISPLLDQNTPDFTTFCSVGEWLQAIKMERYKDNFTAAGYNSLESVARMTIE

SEQ ID NO: 39 - DNA, 1833 bp, Canis familiaris
  CDS (1)..(1830)
atggtttttcaaactcggcacccttcgtggattattttgtgctacatctggctgctccgctttgcacacaccggggaggcgcaggctgccaaggaagtactactgctggattctaaagcacaacaaacagagttggaatggatttcctctccccccaacgggtgggaagaaatcagtggtttggatgagaactacaccccaatacgaacgtaccaggtgtgccaggtcatggaacccaaccaaaacaactggctgcggactaactggatttcgaaaggcaacgcacagaggatttttgtagaattgaaatttaccctgagggattgtaacagtcttcctggagtcctgggaacttgcaaggaaacctttaatttgtactattatgaaacagactacgacactggcaggaatataagagaaaatctctatgtaaaaatagacaccattgctgctgatgaaagttttacccaaggtgaccttggtgaaagaaagatgaagcttaacactgaggtgagagagattggacctttgtccaaaaagggattctatcttgcctttcaggatgtaggggcttgcatagctttggtttctgtcaaagtatactacaagaagtgctggtccattattgagaatttagctatctttccagatacagtgactggttcagaattttcctctttagtcgaggttcgagggacatgtgtcagcagtgcagaggaagaggcggaaaactcccccaggatgcactgcagtgcagaaggagaatggttagtgcccattggaaagtgtatctgcaaagcaggctaccagcaaaaaggggacacttgtgaaccctgtggccgtgggttctacaaatcttcctctcaagatcttcagtgcgctcgttgtccaactcacagtttttctgataaagaaggctcctcaagatgtgaatgtgaggatgggtattacagggctccatctgatccaccgtatgttgcctgcacaaggcctccatctgcgccacagaacctcattttcaacatcaaccaaaccacagtaagtttggaatggagtcctcctgcagataatggaggaagaaatgatgtgacctacagaatattgtgtaagcggtgcagttgggaacagggcgaatgtgttccctgtgggagtaacattggatacatgccacagcagactggattagaggataactatgtcactgtcatggacctgctagcccacgctaattatacttttgaagtggaagctgtcaatggagtttctgacttaagccgatcccagaggctctttgcggctgtcagtatcaccactggtcaagcagctccctcgcaagtgagcggagtgatgaaggagagggtgctgcagcggagtgtcgagctttcctggcaggaaccagagcatcccaatggagtcatcaccgaatatgaaatcaagtattacgagaaagatcaaagggaacggacctattcgacagtaaaaaccaagtccacttcagcttccattaataacctgaagccaggaacagtgtatgttttccagattcgggcttttactgctgctggttatggaaattacagccccagacttgacgttgctacactagaggaagctacaggtaaaatgtttgaagcgacagccgtctccagtgaacagaatcctgttattataattgccgtggttgcagtggcagggaccatcattttggtgttcatggtctttggcttcatcattggaagaaggcactgtggttatagcaaagctgaccaagaaggggatgaagagctttactttcattctttagtaacaaatgagcatctgtcagttttataa

SEQ ID NO: 40 - protein, 610 aa, Canis familiaris
MVFQTRHPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENSPRMHCSAEGEWLVPIGKCICKAGYQQKGDTCEPCGRGFYKSSSQDLQCARCPTHSFSDKEGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSASINNLKPGTVYVFQIRAFTAAGYGNYSPRLDVATLEEATGKMFEATAVSSEQNPVIIIAVVAVAGTIILVFMVFGFIIGRRHCGYSKADQEGDEELYFHSLVTNEHLSVL

SEQ ID NO: 41 - DNA, 2919 bp, Canis familiaris
  CDS (1)..(2916)
atggtttttcaaactcggcacccttcgtggattattttgtgctacatctggctgctccgctttgcacacaccggggaggcgcaggctgccaaggaagtactactgctggattctaaagcacaacaaacagagttggaatggatttcctctccccccaacgggtgggaagaaatcagtggtttggatgagaactacaccccaatacgaacgtaccaggtgtgccaggtcatggaacccaaccaaaacaactggctgcggactaactggatttcgaaaggcaacgcacagaggatttttgtagaattgaaatttaccctgagggattgtaacagtcttcctggagtcctgggaacttgcaaggaaacctttaatttgtactattatgaaacagactacgacactggcaggaatataagagaaaatctctatgtaaaaatagacaccattgctgctgatgaaagttttacccaaggtgaccttggtgaaagaaagatgaagcttaacactgaggtgagagagattggacctttgtccaaaaagggattctatcttgcctttcaggatgtaggggcttgcatagctttggtttctgtcaaagtatactacaagaagtgctggtccattattgagaatttagctatctttccagatacagtgactggttcagaattttcctctttagtcgaggttcgagggacatgtgtcagcagtgcagaggaagaggcggaaaactcccccaggatgcactgcagtgcagaaggagaatggttagtgcccattggaaagtgtatctgcaaagcaggctaccagcaaaaaggggacacttgtgaaccctgtggccgtgggttctacaaatcttcctctcaagatcttcagtgcgctcgttgtccaactcacagtttttctgataaagaaggctcctcaagatgtgaatgtgaggatgggtattacagggctccatctgatccaccgtatgttgcctgcacaaggcctccatctgcgccacagaacctcattttcaacatcaaccaaaccacagtaagtttggaatggagtcctcctgcagataatggaggaagaaatgatgtgacctacagaatattgtgtaagcggtgcagttgggaacagggcgaatgtgttccctgtgggagtaacattggatacatgccacagcagactggattagaggataactatgtcactgtcatggacctgctagcccacgctaattatacttttgaagtggaagctgtcaatggagtttctgacttaagccgatcccagaggctctttgcggctgtcagtatcaccactggtcaagcagctccctcgcaagtgagcggagtgatgaaggagagggtgctgcagcggagtgtcgagctttcctggcaggaaccagagcatcccaatggagtcatcaccgaatatgaaatcaagtattacgagaaagatcaaagggaacggacctattcgacagtaaaaaccaagtccacttcagcttccattaataacctgaagccaggaacagtgtatgttttccagattcgggcttttactgctgctggttatggaaattacagccccagacttgacgttgctacactagaggaagctacagccgtctccagtgaacagaatcctgttattataattgccgtggttgcagtggcagggaccatcattttggtgttcatggtctttggcttcatcattggaagaaggcactgtggttatagcaaagctgaccaagaaggggatgaagagctttactttcattgtaagttgcacttcacaatatcccctcctgtcatgctttcttacatcattacagttaaatttccaggcaccaaaacctacattgaccctgaaacctatgaggacccaaatagagctgtccatcaattcgccaaggagctagatgcctcctgtattaaaattgagcgtgtgattggtgcaggagaatttggagaagtctgcagtggtcgtttgaaacttccagggaaaagagatgttgcagtagccataaaaaccctcaaagttggttacacagaaaaacaaaggagagactttttatgtgaagccagcatcatggggcagtttgaccacccgaatgttgtccatttggaaggggtggttacaagagggaaaccagtcatgatagtaatagaattcatggaaaatggagcccttgatgcatttctcaggaaacacgatgggcaatttaccgtcattcagttagtaggaatgctgagaggaattgctgctggaatgagatatttggctgatatgggatacgttcacagggaccttgcagctcgcaatattcttgtcaacagcaatcttgtttgtaaagtgtcagatttcggcctgtcccgggttatagaggacgatccagaagctgtctatacaacaactggcggaaaaattccagtaaggtggacagcacctgaagccatccaataccggaaattcacatcagccagtgacgtatggagctatggaatagtcatgtgggaagttatgtcttatggagaaagaccttattgggacatgtcaaatcaagatgttataaaagcgatagaagaaggttatcgtttaccagcacccatggactgtccggctggtcttcaccagttgatgctggattgttggcaaaaggaacgtgcagaaaggccaaagtttgaacagatagttggaattctagacaaaatgattcgaaacccaaatagtctgaaaacacccctgggaacttgtagtaggccaataagtcctcttttggatcaaaacactcctgacttcactaccttttgttcagttggagaatggctacaagctattaagatggaaagatataaagataacttcacagcagctggttacaactcccttgaatcagtggccaggatgactattgagtaa

SEQ ID NO: 42 - protein, 972 aa, Canis familiaris
MVFQTRHPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENSPRMHCSAEGEWLVPIGKCICKAGYQQKGDTCEPCGRGFYKSSSQDLQCARCPTHSFSDKEGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSASINNLKPGTVYVFQIRAFTAAGYGNYSPRLDVATLEEATAVSSEQNPVIIIAVVAVAGTIILVFMVFGFIIGRRHCGYSKADQEGDEELYFHCKLHFTISPPVMLSYIITVKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPNSLKTPLGTCSRPISPLLDQNTPDFTTFCSVGEWLQAIKMERYKDNFTAAGYNSLESVARMTIE

SEQ ID NO: 43 - DNA, 2949 bp, Canis familiaris
  CDS (1)..(2946)
atggtttttcaaactcggcacccttcgtggattattttgtgctacatctggctgctccgctttgcacacaccggggaggcgcaggctgccaaggaagtactactgctggattctaaagcacaacaaacagagttggaatggatttcctctccccccaacgggtgggaagaaatcagtggtttggatgagaactacaccccaatacgaacgtaccaggtgtgccaggtcatggaacccaaccaaaacaactggctgcggactaactggatttcgaaaggcaacgcacagaggatttttgtagaattgaaatttaccctgagggattgtaacagtcttcctggagtcctgggaacttgcaaggaaacctttaatttgtactattatgaaacagactacgacactggcaggaatataagagaaaatctctatgtaaaaatagacaccattgctgctgatgaaagttttacccaaggtgaccttggtgaaagaaagatgaagcttaacactgaggtgagagagattggacctttgtccaaaaagggattctatcttgcctttcaggatgtaggggcttgcatagctttggtttctgtcaaagtatactacaagaagtgctggtccattattgagaatttagctatctttccagatacagtgactggttcagaattttcctctttagtcgaggttcgagggacatgtgtcagcagtgcagaggaagaggcggaaaactcccccaggatgcactgcagtgcagaaggagaatggttagtgcccattggaaagtgtatctgcaaagcaggctaccagcaaaaaggggacacttgtgaaccctgtggccgtgggttctacaaatcttcctctcaagatcttcagtgcgctcgttgtccaactcacagtttttctgataaagaaggctcctcaagatgtgaatgtgaggatgggtattacagggctccatctgatccaccgtatgttgcctgcacaaggcctccatctgcgccacagaacctcattttcaacatcaaccaaaccacagtaagtttggaatggagtcctcctgcagataatggaggaagaaatgatgtgacctacagaatattgtgtaagcggtgcagttgggaacagggcgaatgtgttccctgtgggagtaacattggatacatgccacagcagactggattagaggataactatgtcactgtcatggacctgctagcccacgctaattatacttttgaagtggaagctgtcaatggagtttctgacttaagccgatcccagaggctctttgcggctgtcagtatcaccactggtcaagcagctccctcgcaagtgagcggagtgatgaaggagagggtgctgcagcggagtgtcgagctttcctggcaggaaccagagcatcccaatggagtcatcaccgaatatgaaatcaagtattacgagaaagatcaaagggaacggacctattcgacagtaaaaaccaagtccacttcagcttccattaataacctgaagccaggaacagtgtatgttttccagattcgggcttttactgctgctggttatggaaattacagccccagacttgacgttgctacactagaggaagctacagcgacagccgtctccagtgaacagaatcctgttattataattgccgtggttgcagtggcagggaccatcattttggtgttcatggtctttggcttcatcattggaagaagcttaataattcactgcctttcatttaagagcaatgaatattgtaatttctattggatgcatttttattggcactgtggttatagcaaagctgaccaagaaggggatgaagagctttactttcattctgggcacattaaatttccaggcaccaaaacctacattgaccctgaaacctatgaggacccaaatagagctgtccatcaattcgccaaggagctagatgcctcctgtattaaaattgagcgtgtgattggtgcaggagaatttggagaagtctgcagtggtcgtttgaaacttccagggaaaagagatgttgcagtagccataaaaaccctcaaagttggttacacagaaaaacaaaggagagactttttatgtgaagccagcatcatggggcagtttgaccacccgaatgttgtccatttggaaggggtggttacaagagggaaaccagtcatgatagtaatagaattcatggaaaatggagcccttgatgcatttctcaggaaacacgatgggcaatttaccgtcattcagttagtaggaatgctgagaggaattgctgctggaatgagatatttggctgatatgggatacgttcacagggaccttgcagctcgcaatattcttgtcaacagcaatcttgtttgtaaagtgtcagatttcggcctgtcccgggttatagaggacgatccagaagctgtctatacaacaactggcggaaaaattccagtaaggtggacagcacctgaagccatccaataccggaaattcacatcagccagtgacgtatggagctatggaatagtcatgtgggaagttatgtcttatggagaaagaccttattgggacatgtcaaatcaagatgttataaaagcgatagaagaaggttatcgtttaccagcacccatggactgtccggctggtcttcaccagttgatgctggattgttggcaaaaggaacgtgcagaaaggccaaagtttgaacagatagttggaattctagacaaaatgattcgaaacccaaatagtctgaaaacacccctgggaacttgtagtaggccaataagtcctcttttggatcaaaacactcctgacttcactaccttttgttcagttggagaatggctacaagctattaagatggaaagatataaagataacttcacagcagctggttacaactcccttgaatcagtggccaggatgactattgagtaa

SEQ ID NO: 44 - protein, 982 aa, Canis familiaris
MVFQTRHPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENSPRMHCSAEGEWLVPIGKCICKAGYQQKGDTCEPCGRGFYKSSSQDLQCARCPTHSFSDKEGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSASINNLKPGTVYVFQIRAFTAAGYGNYSPRLDVATLEEATATAVSSEQNPVIIIAVVAVAGTIILVFMVFGFIIGRSLIIHCLSFKSNEYCNFYWMHFYWHCGYSKADQEGDEELYFHSGHIKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPNSLKTPLGTCSRPISPLLDQNTPDFTTFCSVGEWLQAIKMERYKDNFTAAGYNSLESVARMTIE

SEQ ID NO: 45 - DNA, 2877 bp, Canis familiaris
  CDS (1)..(2874)
atggtttttcaaactcggcacccttcgtggattattttgtgctacatctggctgctccgctttgcacacaccggggaggcgcaggctgccaaggaagtactactgctggattctaaagcacaacaaacagagttggaatggatttcctctccccccaacgggtgggaagaaatcagtggtttggatgagaactacaccccaatacgaacgtaccaggtgtgccaggtcatggaacccaaccaaaacaactggctgcggactaactggatttcgaaaggcaacgcacagaggatttttgtagaattgaaatttaccctgagggattgtaacagtcttcctggagtcctgggaacttgcaaggaaacctttaatttgtactattatgaaacagactacgacactggcaggaatataagagaaaatctctatgtaaaaatagacaccattgctgctgatgaaagttttacccaaggtgaccttggtgaaagaaagatgaagcttaacactgaggtgagagagattggacctttgtccaaaaagggattctatcttgcctttcaggatgtaggggcttgcatagctttggtttctgtcaaagtatactacaagaagtgctggtccattattgagaatttagctatctttccagatacagtgactggttcagaattttcctctttagtcgaggttcgagggacatgtgtcagcagtgcagaggaagaggcggaaaactcccccaggatgcactgcagtgcagaaggagaatggttagtgcccattggaaagtgtatctgcaaagcaggctaccagcaaaaaggggacacttgtgaaccctgtggccgtgggttctacaaatcttcctctcaagatcttcagtgcgctcgttgtccaactcacagtttttctgataaagaaggctcctcaagatgtgaatgtgaggatgggtattacagggctccatctgatccaccgtatgttgcctgcacaaggcctccatctgcgccacagaacctcattttcaacatcaaccaaaccacagtaagtttggaatggagtcctcctgcagataatggaggaagaaatgatgtgacctacagaatattgtgtaagcggtgcagttgggaacagggcgaatgtgttccctgtgggagtaacattggatacatgccacagcagactggattagaggataactatgtcactgtcatggacctgctagcccacgctaattatacttttgaagtggaagctgtcaatggagtttctgacttaagccgatcccagaggctctttgcggctgtcagtatcaccactggtcaagcagctccctcgcaagtgagcggagtgatgaaggagagggtgctgcagcggagtgtcgagctttcctggcaggaaccagagcatcccaatggagtcatcaccgaatatgaaatcaagtattacgagaaagatcaaagggaacggacctattcgacagtaaaaaccaagtccacttcagcttccattaataacctgaagccaggaacagtgtatgttttccagattcgggcttttactgctgctggttatggaaattacagccccagacttgacgttgctacactagaggaagctacagcgacagccgtctccagtgaacagaatcctgttattataattgccgtggttgcagtggcagggaccatcattttggtctcccttatcacaaaacaaaaccaaaaaaaaaaaaaaagtgaaagaaagaaagaaagaataaaaagggagaagatggctcattctccatctgcctttaaatttccaggcaccaaaacctacattgaccctgaaacctatgaggacccaaatagagctgtccatcaattcgccaaggagctagatgcctcctgtattaaaattgagcgtgtgattggtgcaggagaatttggagaagtctgcagtggtcgtttgaaacttccagggaaaagagatgttgcagtagccataaaaaccctcaaagttggttacacagaaaaacaaaggagagactttttatgtgaagccagcatcatggggcagtttgaccacccgaatgttgtccatttggaaggggtggttacaagagggaaaccagtcatgatagtaatagaattcatggaaaatggagcccttgatgcatttctcaggaaacacgatgggcaatttaccgtcattcagttagtaggaatgctgagaggaattgctgctggaatgagatatttggctgatatgggatacgttcacagggaccttgcagctcgcaatattcttgtcaacagcaatcttgtttgtaaagtgtcagatttcggcctgtcccgggttatagaggacgatccagaagctgtctatacaacaactggcggaaaaattccagtaaggtggacagcacctgaagccatccaataccggaaattcacatcagccagtgacgtatggagctatggaatagtcatgtgggaagttatgtcttatggagaaagaccttattgggacatgtcaaatcaagatgttataaaagcgatagaagaaggttatcgtttaccagcacccatggactgtccggctggtcttcaccagttgatgctggattgttggcaaaaggaacgtgcagaaaggccaaagtttgaacagatagttggaattctagacaaaatgattcgaaacccaaatagtctgaaaacacccctgggaacttgtagtaggccaataagtcctcttttggatcaaaacactcctgacttcactaccttttgttcagttggagaatggctacaagctattaagatggaaagatataaagataacttcacagcagctggttacaactcccttgaatcagtggccaggatgactattgagtaa

SEQ ID NO: 46 - protein, 958 aa, Canis familiaris
MVFQTRHPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENSPRMHCSAEGEWLVPIGKCICKAGYQQKGDTCEPCGRGFYKSSSQDLQCARCPTHSFSDKEGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSASINNLKPGTVYVFQIRAFTAAGYGNYSPRLDVATLEEATATAVSSEQNPVIIIAVVAVAGTIILVSLITKQNQKKKKSERKKERIKREKMAHSPSAFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPNSLKTPLGTCSRPISPLLDQNTPDFTTFCSVGEWLQAIKMERYKDNFTAAGYNSLESVARMTIE

SEQ ID NO: 47 - DNA, 2865 bp, Canis familiaris
  CDS (1)..(2862)
atggtttttcaaactcggcacccttcgtggattattttgtgctacatctggctgctccgctttgcacacaccggggaggcgcaggctgccaaggaagtactactgctggattctaaagcacaacaaacagagttggaatggatttcctctccccccaacgggtgggaagaaatcagtggtttggatgagaactacaccccaatacgaacgtaccaggtgtgccaggtcatggaacccaaccaaaacaactggctgcggactaactggatttcgaaaggcaacgcacagaggatttttgtagaattgaaatttaccctgagggattgtaacagtcttcctggagtcctgggaacttgcaaggaaacctttaatttgtactattatgaaacagactacgacactggcaggaatataagagaaaatctctatgtaaaaatagacaccattgctgctgatgaaagttttacccaaggtgaccttggtgaaagaaagatgaagcttaacactgaggtgagagagattggacctttgtccaaaaagggattctatcttgcctttcaggatgtaggggcttgcatagctttggtttctgtcaaagtatactacaagaagtgctggtccattattgagaatttagctatctttccagatacagtgactggttcagaattttcctctttagtcgaggttcgagggacatgtgtcagcagtgcagaggaagaggcggaaaactcccccaggatgcactgcagtgcagaaggagaatggttagtgcccattggaaagtgtatctgcaaagcaggctaccagcaaaaaggggacacttgtgaaccctgtggccgtgggttctacaaatcttcctctcaagatcttcagtgcgctcgttgtccaactcacagtttttctgataaagaaggctcctcaagatgtgaatgtgaggatgggtattacagggctccatctgatccaccgtatgttgcctgcacaaggcctccatctgcgccacagaacctcattttcaacatcaaccaaaccacagtaagtttggaatggagtcctcctgcagataatggaggaagaaatgatgtgacctacagaatattgtgtaagcggtgcagttgggaacagggcgaatgtgttccctgtgggagtaacattggatacatgccacagcagactggattagaggataactatgtcactgtcatggacctgctagcccacgctaattatacttttgaagtggaagctgtcaatggagtttctgacttaagccgatcccagaggctctttgcggctgtcagtatcaccactggtcaagcagctccctcgcaagtgagcggagtgatgaaggagagggtgctgcagcggagtgtcgagctttcctggcaggaaccagagcatcccaatggagtcatcaccgaatatgaaatcaagtattacgagaaagatcaaagggaacggacctattcgacagtaaaaaccaagtccacttcagcttccattaataacctgaagccaggaacagtgtatgttttccagattcgggcttttactgctgctggttatggaaattacagccccagacttgacgttgctacactagaggaagctacagaatctaataattcaaatgacagattaccactatcaatcagtgcaaaaatgtgtgggttaaagacacaaattgtgcgcactgttattatcattactattatcactgtatctaaaatacgtaaagcacaaagctatgtcatgctttcttacatcattacagttaaatttccaggcaccaaaacctacattgaccctgaaacctatgaggacccaaatagagctgtccatcaattcgccaaggagctagatgcctcctgtattaaaattgagcgtgtgattggtgcaggagaatttggagaagtctgcagtggtcgtttgaaacttccagggaaaagagatgttgcagtagccataaaaaccctcaaagttggttacacagaaaaacaaaggagagactttttatgtgaagccagcatcatggggcagtttgaccacccgaatgttgtccatttggaaggggtggttacaagagggaaaccagtcatgatagtaatagaattcatggaaaatggagcccttgatgcatttctcaggaaacacgatgggcaatttaccgtcattcagttagtaggaatgctgagaggaattgctgctggaatgagatatttggctgatatgggatacgttcacagggaccttgcagctcgcaatattcttgtcaacagcaatcttgtttgtaaagtgtcagatttcggcctgtcccgggttatagaggacgatccagaagctgtctatacaacaactggcggaaaaattccagtaaggtggacagcacctgaagccatccaataccggaaattcacatcagccagtgacgtatggagctatggaatagtcatgtgggaagttatgtcttatggagaaagaccttattgggacatgtcaaatcaagatgttataaaagcgatagaagaaggttatcgtttaccagcacccatggactgtccggctggtcttcaccagttgatgctggattgttggcaaaaggaacgtgcagaaaggccaaagtttgaacagatagttggaattctagacaaaatgattcgaaacccaaatagtctgaaaacacccctgggaacttgtagtaggccaataagtcctcttttggatcaaaacactcctgacttcactaccttttgttcagttggagaatggctacaagctattaagatggaaagatataaagataacttcacagcagctggttacaactcccttgaatcagtggccaggatgactattgagtaa

SEQ ID NO: 48 - protein, 954 aa, Canis familiaris
MVFQTRHPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENSPRMHCSAEGEWLVPIGKCICKAGYQQKGDTCEPCGRGFYKSSSQDLQCARCPTHSFSDKEGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSASINNLKPGTVYVFQIRAFTAAGYGNYSPRLDVATLEEATESNNSNDRLPLSISAKMCGLKTQIVRTVIIITIITVSKIRKAQSYVMLSYIITVKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPNSLKTPLGTCSRPISPLLDQNTPDFTTFCSVGEWLQAIKMERYKDNFTAAGYNSLESVARMTIE

SEQ ID NO: 49 - DNA, 2865 bp, Canis familiaris
  CDS (1)..(2862)
atggtttttcaaactcggcacccttcgtggattattttgtgctacatctggctgctccgctttgcacacaccggggaggcgcaggctgccaaggaagtactactgctggattctaaagcacaacaaacagagttggaatggatttcctctccccccaacgggtgggaagaaatcagtggtttggatgagaactacaccccaatacgaacgtaccaggtgtgccaggtcatggaacccaaccaaaacaactggctgcggactaactggatttcgaaaggcaacgcacagaggatttttgtagaattgaaatttaccctgagggattgtaacagtcttcctggagtcctgggaacttgcaaggaaacctttaatttgtactattatgaaacagactacgacactggcaggaatataagagaaaatctctatgtaaaaatagacaccattgctgctgatgaaagttttacccaaggtgaccttggtgaaagaaagatgaagcttaacactgaggtgagagagattggacctttgtccaaaaagggattctatcttgcctttcaggatgtaggggcttgcatagctttggtttctgtcaaagtatactacaagaagtgctggtccattattgagaatttagctatctttccagatacagtgactggttcagaattttcctctttagtcgaggttcgagggacatgtgtcagcagtgcagaggaagaggcggaaaactcccccaggatgcactgcagtgcagaaggagaatggttagtgcccattggaaagtgtatctgcaaagcaggctaccagcaaaaaggggacacttgtgaaccctgtggccgtgggttctacaaatcttcctctcaagatcttcagtgcgctcgttgtccaactcacagtttttctgataaagaaggctcctcaagatgtgaatgtgaggatgggtattacagggctccatctgatccaccgtatgttgcctgcacaaggcctccatctgcgccacagaacctcattttcaacatcaaccaaaccacagtaagtttggaatggagtcctcctgcagataatggaggaagaaatgatgtgacctacagaatattgtgtaagcggtgcagttgggaacagggcgaatgtgttccctgtgggagtaacattggatacatgccacagcagactggattagaggataactatgtcactgtcatggacctgctagcccacgctaattatacttttgaagtggaagctgtcaatggagtttctgacttaagccgatcccagaggctctttgcggctgtcagtatcaccactggtcaagcagctccctcgcaagtgagcggagtgatgaaggagagggtgctgcagcggagtgtcgagctttcctggcaggaaccagagcatcccaatggagtcatcaccgaatatgaaatcaagtattacgagaaaaacaaaggcatggaacggacctattcgacagtaaaaaccaagtccacttcagcttccattaataacctgaagccaggaacagtgtatgttttccagattcgggcttttactgctgctggttatggaaattacagccccagacttgacgttgctacactagaggaagctacagcaggatcagaaaagcttgatgaacagaatcctgttattataattgccgtggttgcaaattacatcaattatcgtgtcatttatcaaattactttaataaaaagggagaagatggctcattctccatctgcctgccaatctaggaggttaacctattttaaatttccaggcaccaaaacctacattgaccctgaaacctatgaggacccaaatagagctgtccatcaattcgccaaggagctagatgcctcctgtattaaaattgagcgtgtgattggtgcaggagaatttggagaagtctgcagtggtcgtttgaaacttccagggaaaagagatgttgcagtagccataaaaaccctcaaagttggttacacagaaaaacaaaggagagactttttatgtgaagccagcatcatggggcagtttgaccacccgaatgttgtccatttggaaggggtggttacaagagggaaaccagtcatgatagtaatagaattcatggaaaatggagcccttgatgcatttctcaggaaacacgatgggcaatttaccgtcattcagttagtaggaatgctgagaggaattgctgctggaatgagatatttggctgatatgggatacgttcacagggaccttgcagctcgcaatattcttgtcaacagcaatcttgtttgtaaagtgtcagatttcggcctgtcccgggttatagaggacgatccagaagctgtctatacaacaactggcggaaaaattccagtaaggtggacagcacctgaagccatccaataccggaaattcacatcagccagtgacgtatggagctatggaatagtcatgtgggaagttatgtcttatggagaaagaccttattgggacatgtcaaatcaagatgttataaaagcgatagaagaaggttatcgtttaccagcacccatggactgtccggctggtcttcaccagttgatgctggattgttggcaaaaggaacgtgcagaaaggccaaagtttgaacagatagttggaattctagacaaaatgattcgaaacccaaatagtctgaaaacacccctgggaacttgtagtaggccaataagtcctcttttggatcaaaacactcctgacttcactaccttttgttcagttggagaatggctacaagctattaagatggaaagatataaagataacttcacagcagctggttacaactcccttgaatcagtggccaggatgactattgagtaa

SEQ ID NO: 50 - protein, 954 aa, Canis familiaris
MVFQTRHPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENSPRMHCSAEGEWLVPIGKCICKAGYQQKGDTCEPCGRGFYKSSSQDLQCARCPTHSFSDKEGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKNKGMERTYSTVKTKSTSASINNLKPGTVYVFQIRAFTAAGYGNYSPRLDVATLEEATAGSEKLDEQNPVIIIAVVANYINYRVIYQITLIKREKMAHSPSACQSRRLTYFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPNSLKTPLGTCSRPISPLLDQNTPDFTTFCSVGEWLQAIKMERYKDNFTAAGYNSLESVARMTIE

SEQ ID NO: 51 - DNA, 2388 bp, Canis familiaris
  CDS (1)..(2385)
atggtttttcaaactcggcacccttcgtggattattttgtgctacatctggctgctccgctttgcacacaccggggaggcgcaggctgccaaggaagtactactgctggattctaaagcacaacaaacagagttggaatggatttcctctccccccaacgggtgggaagaaatcagtggtttggatgagaactacaccccaatacgaacgtaccaggtgtgccaggtcatggaacccaaccaaaacaactggctgcggactaactggatttcgaaaggcaacgcacagaggatttttgtagaattgaaatttaccctgagggattgtaacagtcttcctggagtcctgggaacttgcaaggaaacctttaatttgtactattatgaaacagactacgacactggcaggaatataagagaaaatctctatgtaaaaatagacaccattgctgctgatgaaagttttacccaaggtgaccttggtgaaagaaagatgaagcttaacactgaggtgagagagattggacctttgtccaaaaagggattctatcttgcctttcaggatgtaggggcttgcatagctttggtttctgtcaaagtatactacaagaagtgctggtccattattgagaatttagctatctttccagatacagtgactggttcagaattttcctctttagtcgaggttcgagggacatgtgtcagcagtgcagaggaagaggcggaaaactcccccaggatgcactgcagtgcagaaggagaatggttagtgcccattggaaagtgtatctgcaaagcaggctaccagcaaaaaggggacacttgtgaacctccctcgcaagtgagcggagtgatgaaggagagggtgctgcagcggagtgtcgagctttcctggcaggaaccagagcatcccaatggagtcatcaccgaatatgaaatcaagtattacgagaaagatcaaagggaacggacctattcgacagtaaaaaccaagtccacttcagcttccattaataacctgaagccaggaacagtgtatgttttccagattcgggcttttactgctgctggttatggaaattacagccccagacttgacgttgctacactagaggaagctacagcgacagccgtctccagtgaacagaatcctgttattataattgccgtggttgcagtggcagggaccatcattttggtgttcatggtctttggcttcatcattggaagaaggcactgtggttatagcaaagctgaccaagaaggggatgaagagctttactttcattctgggcacattaaatttccaggcaccaaaacctacattgaccctgaaacctatgaggacccaaatagagctgtccatcaattcgccaaggagctagatgcctcctgtattaaaattgagcgtgtgattggtgcaggagaatttggagaagtctgcagtggtcgtttgaaacttccagggaaaagagatgttgcagtagccataaaaaccctcaaagttggttacacagaaaaacaaaggagagactttttatgtgaagccagcatcatggggcagtttgaccacccgaatgttgtccatttggaaggggtggttacaagagggaaaccagtcatgatagtaatagaattcatggaaaatggagcccttgatgcatttctcaggaaacacgatgggcaatttaccgtcattcagttagtaggaatgctgagaggaattgctgctggaatgagatatttggctgatatgggatacgttcacagggaccttgcagctcgcaatattcttgtcaacagcaatcttgtttgtaaagtgtcagatttcggcctgtcccgggttatagaggacgatccagaagctgtctatacaacaactggcggaaaaattccagtaaggtggacagcacctgaagccatccaataccggaaattcacatcagccagtgacgtatggagctatggaatagtcatgtgggaagttatgtcttatggagaaagaccttattgggacatgtcaaatcaagatgttataaaagcgatagaagaaggttatcgtttaccagcacccatggactgtccggctggtcttcaccagttgatgctggattgttggcaaaaggaacgtgcagaaaggccaaagtttgaacagatagttggaattctagacaaaatgattcgaaacccaaatagtctgaaaacacccctgggaacttgtagtaggccaataagtcctcttttggatcaaaacactcctgacttcactaccttttgttcagttggagaatggctacaagctattaagatggaaagatataaagataacttcacagcagctggttacaactcccttgaatcagtggccaggatgactattgagtaa

SEQ ID NO: 52 - protein, 795 aa, Canis familiaris
MVFQTRHPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENSPRMHCSAEGEWLVPIGKCICKAGYQQKGDTCEPPSQVSGVMKERVLQRSVELSWQEPEHPNGVITEYEIKYYEKDQRERTYSTVKTKSTSASINNLKPGTVYVFQIRAFTAAGYGNYSPRLDVATLEEATATAVSSEQNPVIIIAVVAVAGTIILVFMVFGFIIGRRHCGYSKADQEGDEELYFHSGHIKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPNSLKTPLGTCSRPISPLLDQNTPDFTTFCSVGEWLQAIKMERYKDNFTAAGYNSLESVARMTIE

SEQ ID NO: 53 - DNA, 2997 bp, Equus caballus
  CDS (1)..(2994)
atggtttttcaaactcggcacccttcgtggattattttatgctacatctcgctgctccgcttcgcacacaccggcgacgcgcaagctgcaaaggaagtactactgttggattctaaagcacaacaaacagagttggaatggatttcctctccgcccaatgggtgggaagaaattagtggtttggatgagaactacaccccgatacgaacataccaggtgtgccaggtcatggagcccaaccaaaacaactggctgcggactaactggatttcgaaaggcaatgcacaaaggatttttgtagaattgaaattcaccctgagggattgtaacagtcttcctggagtactgggaacttgcaaggaaacctttaatttgtactattatgaaacagactacgatactggcaggaatataagagagaacctctatgtaaaaatagacaccattgctgcagatgaaagttttacccaaggtgaccttggggaaagaaagatgaagcttaacactgaggtgagagagattggacctttgtccaaaaagggattctatcttgcctttcaggatgtaggggcttgcatagctttggtttctgtcaaagtgtactacaagaagtgctggtccattattgagaacttagctatctttccagatacagtgactggttcagaattttcctctttagtcgaggttcgagggacatgtgtcagcagtgcagaggaagaggcggaaaactcccccaggatgcactgcagtgcggaaggagaatggttagtgcccattggaaagtgtatctgcaaagcaggctaccagcaaaaaggggacacttgtgaaccctgtggccgtgggttctacaaatcttcctctcaagatcttcagtgctctcgttgtcctactcacagtttttctgataaagaaggctcctcaaggtgtgaatgtgaagatgggtattacagggctccgtccgatcctccgtatgttgcgtgtacaaggcctccatctgcaccacagaacctcattttcaacatcaaccaaaccacagtgagtttggagtggagtcctcctgcagacaacgggggaagaaacgacgtgacctacagaatattgtgtaagcggtgcagttgggagcagggcgaatgtgttccctgtgggagtaacattggatacatgccccagcagactggattagaggataactatgtcactgtcatggacctgctggcccatgctaattacactttcgaagttgaagctgtaaatggagtttctgacctaagccgatcccagaggctctttgcagctgtcagtatcaccactggtcaagcagctccctcgcaagtgagcggagtgatgaaggagagagtcttgcagcggagcgtcgagctttcctggcaggaaccggagcatcccaatggagtcatcaccgaatatgaaatcaagtattacgagaaagatcaaagggaacggacctactcaacactaaagaccaagtccacttcagcctccattaataacctgaaaccgggaacagtgtatgttttccagatccgagcttttaccgctgctggttatggaaattacagtcccagacttgatgttgctacactagaggaagctacaggtaaaatgtttgaagctacagccgtctctagcgaacagaatcctgttattatcattgcggtggtcgccgtggctgggaccatcattttggtcttcatggtctttggcttcatcattggaagaaggcactgtggttatagcaaagctgaccaggaaggggatgaagaactttactttcattttaaatttccaggcaccaaaacctacattgaccctgaaacctatgaggacccaaatagagctgtccatcaattcgccaaggagctagatgcctcctgtattaaaattgagcgtgtgatcggtgcaggagaatttggggaagtctgcagtggtcgtttgaaacttccaggaaaaagagacgttgcagtagccataaaaaccttgaaagtcggttacacagaaaaacaaaggagagactttttatgtgaagcaagcatcatggggcagtttgaccacccaaatgttgtccatttggaaggggttgttacaagagggaaaccagtcatgattgtaatagaattcatggaaaatggggccctagatgcgtttctcaggaaacacgatgggcaatttacagtcattcagttagtaggaatgctgagaggaattgctgctggaatgagatatttggctgatatgggatatgttcacagggaccttgcagctcgcaatattcttgtcaacagcaatcttgtttgtaaagtgtcagattttggcctgtcccgggttatagaggatgatccagaagctgtctacacaacaaccggtggaaaaattccagtaaggtggacagcaccagaagccatccaataccggaagttcacgtcagccagtgatgtatggagctatggaatagtcatgtgggaagttatgtcttatggagaaagaccttactgggacatgtcaaatcaagatgttataaaagcaatagaagaaggttatcgtttaccagcacccatggactgcccagctggtcttcaccagctaatgctggattgttggcaaaaggaacgcgctgagaggccaaagtttgaacagatagttggaattctagacaaaatgattcgaaacccaaatagcctgaaaacacccctgggaacttgtagtaggccaataagccctcttttggatcagaacactcctgacttcactaccttttgttcagttggagaatggctacaagctattaagatggaaagatacaaagacaacttcacggcagccggctacaactcccttgaatcagtagccaggatgactattgaggatgtgatgagtttggggatcacattggttggccatcaaaagaaaatcatgagcagcattcagactatgagagcacaaatgctccatttacatggaaccggcatccaagtgtga

SEQ ID NO: 54 - protein, 998 aa, Equus caballus
MVFQTRHPSWIILCYISLLRFAHTGDAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENSPRMHCSAEGEWLVPIGKCICKAGYQQKGDTCEPCGRGFYKSSSQDLQCSRCPTHSFSDKEGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTLKTKSTSASINNLKPGTVYVFQIRAFTAAGYGNYSPRLDVATLEEATGKMFEATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPNSLKTPLGTCSRPISPLLDQNTPDFTTFCSVGEWLQAIKMERYKDNFTAAGYNSLESVARMTIEDVMSLGITLVGHQKKIMSSIQTMRAQMLHLHGTGIQV

SEQ ID NO: 55 - DNA, 2997 bp, Bos Taurus
  CDS (1)..(2994)
  misc_feature (2409)..(2419): n is a, c, g, or t
atggtttttcaaactcggcacccttcatggattattttatgctacatctggctgctccactttgcacacaccggagaagcgcaggctgcaaaggaagtactactgctggattctaaagcacaacaaacagagttggaatggatttcctctccacccaatgggtgggaagaaattagtggtttggacgagaactataccccaatccgaacataccaggtttgccaggtcatggagcccaaccaaaacaactggctgcggactaactggatttcgaaaggcaatgcacaaaggatttttgtagaattgaaattcaccctgagggattgtaacagtcttcctggagtcctgggaacttgcaaggaaacctttaatttgtactattatgaaacagactacgacactggcaggaatataagagaaaatctctatgtcaaaatagacaccattgctgcagatgaaagttttacccaaggtgaccttggtgaaagaaagatgaagcttaacactgaggtgagagagattggacctttgtccaaaaagggattctatcttgcctttcaggatgtaggggcttgcatagctttggtttcagtcaaagtgtactacaagaagtgctggtccattattgagaacttagctatctttccagatacagtgactggttcagaattttcctctttagtcgaggtccgagggacatgtgtcagcagtgcagaggaagaagcggaaaactctcccaggatgcactgcagcgcagaaggagaatggttagtgcccattggaaaatgtatctgcaaagcaggcttccagcagaaaggggacacttgtgaaccctgtggccgtgggttctacaaatcttcctctcaagatcttcagtgctctcgttgtccaactcacagtttttctgataaagaaggctcctcaaggtgtgactgtgaggatgggtactacagggctccatctgacccaccgtatgtggcatgcacaaggcctccatctgcaccacagaacctcattttcaatatcaaccaaaccacagtgagcttggaatggagtccccctgcagacaatgggggaagaaatgatgtgacctatagaatactgtgtaagcgatgcagctgggagcagggcgaatgcgttccctgtgggagtaacattggctacatgccccagcagactggattagaggataactatgtcactgtcatggacctgctggcccacgctaattatacttttgaagttgaagctgtaaatggagtttctgacttaagtcgatcccagaggctctttgcggctgtcagtgtcaccacaggtcaagcagctccctcgcaagtgagcggagtaatgaaggagagagtgctgcagcggagtgtggagctttcctggcaggaacccgaacatcccaatggagtcatcaccgaatatgaaatcaagtattacgagaaagatcaaagggaacggacctactcgacattaaaaaccaagtccacttcagcctccattaataacttgaagccaggaacggtgtatgttttccagattcgggcttttactgctgctggttatggaaattacagtcccagacttgacgttgctacactagaggaagccacaggtaaaatgtttgaagctacggcagtctcaagtgaacagaatcctgttattataattgctgtggttgcagtggccgggactatcattttggtgttcatggtctttggcttcatcattggaagaaggcactgtggttatagcaaagctgaccaagaaggggatgaagagctttactttcattttaaatttccaggcaccaaaacctacattgaccctgaaacctatgaggacccaaatagagctgtccatcaattcgccaaggagctagatgcctcctgtattaaaattgagcgtgtgattggcgcaggagaatttggagaagtctgcagtggtcgtttgaaactcccagggaaaagagatgttgcagtagccataaaaaccctgaaagttggttacacggaaaagcaaaggagagactttttatgtgaagccagcatcatggggcaatttgaccacccaaatgttgtccatttggaaggggttgttacaagagggaagccagtcatgattgtaatagaattcatggaaaatggagccctagatgcatttctcaggaaacacgatgggcaatttacagtcattcagttagtaggaatgctgagaggaattgctgctggaatgagatatttggctgatatgggatatgttcacagggaccttgcagctcgcaatattcttgtcaacagcaatcttgtttgtaaagtgtcagattttggcctgtcccgggttatagaggatgatcccgaagctgtctatacaacgactgtaagaaaaataatgataagaatgtcnnnnnnnnnnnccatccaataccggaatttcacatcagccagcgacgtatggagctatggaatagtcatgtgggaagttatgtcttatggagagagaccttattgggacatgtcaaatcaagatgttataaaggcaatagaagaaggttatcgcctgccagcacccatggactgcccagctggtcttcaccagctgatgctggattgttggcagaaggaacgtgctgaaaggccaaagtttgaacagatagttggaattctagacaaaatgattcgaaacccaaatagtctgaagacacccctgggaacatgtagtaggccaataagccctcttttggatcaaaacactcctgacttcactaccttctgttcagttggagaatggctacaagctattaagatggaaagatataaagataacttcacagcagccggctacaactcccttgaatcagtggccaggatgactattgaggatgtgatgagtttagggatcacactggtgggccatcagaagaaaatcatgagcagcattcagactatgagagcgcaaatgctccatttacatggaactggcatccaagtgtga

SEQ ID NO: 56 - protein, 998 aa, Bos Taurus
  misc_feature (803)..(803): The 'Xaa' at location 803 stands for Ser.
  misc_feature (804)..(804): The 'Xaa' at location 804 stands for Lys, Asn, Arg, Ser, Thr, Ile, Met, Glu, Asp, Gly, Ala, Val, Gln, His, Pro, Leu, Tyr, Trp, Cys, or Phe.
  misc_feature (805)..(805): The 'Xaa' at location 805 stands for Lys, Asn, Arg, Ser, Thr, Ile, Met, Glu, Asp, Gly, Ala, Val, Gln, His, Pro, Leu, Tyr, Trp, Cys, or Phe.
  misc_feature (806)..(806): The 'Xaa' at location 806 stands for Lys, Asn, Arg, Ser, Thr, Ile, Met, Glu, Asp, Gly, Ala, Val, Gln, His, Pro, Leu, Tyr, Trp, Cys, or Phe.
  misc_feature (807)..(807): The 'Xaa' at location 807 stands for Thr, Ala, Pro, or Ser.
MVFQTRHPSWIILCYIWLLHFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENSPRMHCSAEGEWLVPIGKCICKAGFQQKGDTCEPCGRGFYKSSSQDLQCSRCPTHSFSDKEGSSRCDCEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSVTTGQAAPSQVSGVMKERVLQRSVELSWQEPEHPNGVITEYEIKYYEKDQRERTYSTLKTKSTSASINNLKPGTVYVFQIRAFTAAGYGNYSPRLDVATLEEATGKMFEATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTVRKIMIRMXXXXXIQYRNFTSASDVWSYGIVMWEVMSYGERPYWDMSNQDVIKAIEEGYRLPAPMDCPAGLHQLMLDCWQKERAERPKFEQIVGILDKMIRNPNSLKTPLGTCSRPISPLLDQNTPDFTTFCSVGEWLQAIKMERYKDNFTAAGYNSLESVARMTIEDVMSLGITLVGHQKKIMSSIQTMRAQMLHLHGTGIQV

SEQ ID NO: 57 - DNA, 2982 bp, Gallus gallus
  CDS (1)..(2979)
atggttttgcgaagtcggctccctccttggattatgttgtgctccgtctggctgctccgctttgcacacacgggggaggcacaggctgcgaaagaagttatattactggactctaaagcacaacagacagagttggaatggatttcctctcctcccaatgggtgggaagaaattagtggactggatgaaaactacactcctatacgaacataccaggtatgccaggtcatggaatcgaatcaaaacaactggcttcggactaactggattgcaaaaagcaatgcacaaaggatttttgtagaactgaaattcactctgagggattgtaacagtcttcctggagttctggggacttgtaaagaaacttttaacttgtattattatgaaacagactacgatactggcaggaatatcagagaaaatcaatatgtaaaaatagacactattgcagcagatgaaagttttacccagggtgatctgggggagagaaaaatgaaacttaacacagaggtgagagaaattggacctttgtccaaaaaaggattctatcttgcatttcaggatgtaggggcctgcattgctttggtctctgtcaaagtctactacaagaagtgctggtccatcattgagaacttagctatttttcctgacacagtgactggctcagagttttcctctttagttgaagtacgaggaacttgtgtcagcagtgcagaggaggaagctgagaactctccgaagatgcactgtagcgcagagggagaatggctagtgcctattggaaagtgtatctgcaaagcaggatatcagcagaaaggagacacctgtgaaccttgtggccgtgggttctacaaatcatcttcacaagatctccagtgctcccgctgccctactcacagcttttctgacaaggaaggatcttcaagatgtgactgtgaagatagctattatagagcaccttctgatccaccatatgttgcatgcacaagacctccatctgcaccacagaacctcattttcaacatcaaccagactactgtgagtttagagtggagtcctcctgctgacaatgggggaagaaatgatgtgacctaccgcattttgtgcaagaggtgcagctgggagcagggtgaatgtgttccttgtgggagtaacattggatatatgccccagcaaactggattagtagataactatgtcactgtcatggaccttcttgctcatgctaactacacatttgaagttgaagctgtgaatggggtgtctgacttgagtcgttcccagaggctttttgcagctgtcagtattaccactggtcaagcagctccctcacaagttagtggagtaatgaaagagagagtgctgcagaggagcgtggagctttcctggcaggaaccagaacatcccaacggagtcattactgaatatgaaatcaagtattatgagaaagatcaaagggagagaacctattcaacagtaaaaaccaagtccacttcagcttctattaataacttaaagccaggaacagtatatgttttccagattcgtgcttttactgctgctggttatggaaattatagccccagactggatgttgccacactagaagaagccacagccaccgctgtttccagtgaacagaatcctgttattatcatagctgtagtcgctgtggcaggaacaatcattctggtctttatggtgtttggattcatcattgggcgaaggcattgtggctatagcaaagctgatcaagaaggggatgaagagctttactttcattttaaatttccaggcaccaaaacctacattgaccctgaaacctacgaggacccaaatagagctgtccatcaattcgccaaggagctagatgcctcttgtattaaaattgagcgtgtgattggtgcaggagaatttggtgaagtgtgcagtgggcgtctaaagcttcctggcaagagagatgttgcagtagccataaaaactctgaaggttggctacacggaaaagcaacggagagatttcctgtgtgaagcgagcatcatgggacaatttgaccaccccaatgttgttcacttagaaggggttgttaccagagggaaaccagtcatgattgtaatagaatacatggaaaatggggcattggatgcatttcttaggaaacatgatgggcaatttacagtcattcagctggtaggaatgctgagaggaatcgctgctggaatgagatatttggccgatatgggatatgtacacagggatcttgcagcacgcaatattcttgtcaacagcaaccttgtttgtaaagtatcagactttggcctttccagggttatagaagatgatccagaagccgtttacactaccactggtggaaaaattccagtgagatggacagctccagaggccatccagtaccgcaaatttacatcagccagtgatgtatggagttatggaatcgttatgtgggaagtaatgtcttatggagaacgcccttactgggacatgtccaatcaagatgttataaaagcaatcgaagaaggctatcgtttgccagcgcccatggattgcccagcaggactacaccagctgatgctagactgctggcagaaagaacgtggtgaaaggccaaagtttgagcagatagttgggattctggacaaaatgattaggaatccaaacagcttgaaaacccctctgggaacttgtagcagaccaattagccctcttctggaccagaacactcccgattttaccactttctgctccgtaggcgaatggttacaagctattaagatggaaagatataaggataatttcacagcagcaggctacaactctcttgaatcagttgccaggatgactattgaggatgtgatgagtttagggatcacgttggttggtcatcaaaagaaaatcatgagcagcattcagactatgagagcacaaatgctacatttacacggcactggcatccaagtgtga

SEQ ID NO: 58 - protein, 993 aa, Gallus gallus
MVLRSRLPPWIMLCSVWLLRFAHTGEAQAAKEVILLDSKAQQTELEWISSPPNGWEEISGLDENYTPIRTYQVCQVMESNQNNWLRTNWIAKSNAQRIFVELKFTLRDCNSLPGVLGTCKETFNLYYYETDYDTGRNIRENQYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENSPKMHCSAEGEWLVPIGKCICKAGYQQKGDTCEPCGRGFYKSSSQDLQCSRCPTHSFSDKEGSSRCDCEDSYYRAPSDPPYVACTRPPSAPQNLIFNINQTTVSLEWSPPADNGGRNDVTYRILCKRCSWEQGECVPCGSNIGYMPQQTGLVDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSASINNLKPGTVYVFQIRAFTAAGYGNYSPRLDVATLEEATATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEYMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERGERPKFEQIVGILDKMIRNPNSLKTPLGTCSRPISPLLDQNTPDFTTFCSVGEWLQAIKMERYKDNFTAAGYNSLESVARMTIEDVMSLGITLVGHQKKIMSSIQTMRAQMLHLHGTGIQV

SEQ ID NO: 59 - DNA, 2988 bp, Ornithorhynchus anatinus
  CDS (1)..(2985)
atggtggtccgcccctcctggattatcgcatgctacctctggctgctccgcctggcgcgcccgggggaggctcaggcggcgagagaagtaatactgctggactcaaaatcacaacagacagaattggaatggatttcttctccttccaatgggtgggaagaaattagtggattggatgaaaactacacccctatacggacataccaggtatgccaggttatggaacctaatcaaaacaactggcttcggactagctggattgcaaaaggcaatgcacaaaggatttttgtagaactgaaattcaccctgagggattgtaacagtcttcctggagtcctgggcacatgtaaagaaacctttaatttgtattattatgaaacagactacgacactggcaggaatataagagaaaacctgtatgtaaaaatagacactatcgctgccgatgaaagctttacccagggtgaccttggtgagagaaagatgaaacttaacactgaggtgagagagatcggacctttgtctaaaaagggcttctaccttgcctttcaggatgtaggggcctgtattgctctcgtgtcagtcaaagtgtactacaagaagtgctggtccattattgagaacttagctatctttccagatacagtgaccggctcagagttttcctccctagttgaggtgcgcgggacctgtgttcacagtgcggaagaggaggccgagaattctcctcggatgcactgcagcgctgaaggagaatggctggtccctattggaaagtgtatctgcaaagctggctaccagcagaaaggagacacttgtgaaccttgtggacgcggattctataaatcttcttcccaagacctgcagtgctcacggtgtccaagccacagtttttcagacaaagaaggatcttcccgatgtgattgtgaggatggctactaccgagctctcgctgatcctccgtatgtcgcttgcacaaggccaccatctgcaccacagaacctcattttcaatattaaccagacgacggtgagcttggagtggaaccctccagcagataacggaggaaggaatgacgttacctaccgagtgttgtgtaagcgatgcagttgggagcagggcgagtgcgttccttgcggaagtaacgttggctacttgccccagcaaagtggattagcagataacttcgtcacggtcacggacctgctagcccatgccaattacacatttgaagttgaggctgtgaatggggtctccgacctgagccgttcccagagactttttgctgccgtcagtatcaccacaggccaagcagctccttcacaagttagcggcgtcatgaaggaaagagtactgcaaaggagtgtcgagctttcctggcaggaaccagagcatcccaatggagtcatcacggaatacgaaatcaagtattatgagaaagatcaaagggaacggacctactcaacagttaaaaccaaatccacttccgtctccattaataatctgaaaccaggaacagtgtatgtgttccagatccgggctttcactgctgccggttatggaaattacagtcccagacttgatgttgctacactagaggaagctacaggtaaaatgtttgaagccactgcagtctccagtgaacagaaccctgtcattatcatagctgtggttgctgtggccggaacaatcatactggtcttcatggtttttggcttcatcattggcagaaggcattgtggctatagcaaagcagaccaagaaggagacgaagaactttactttcattttaaatttccaggcaccaaaacctacattgaccctgaaacctatgaggacccaaatagagctgtccatcaattcgccaaggagctagacgcctcttgtattaaaattgagcgtgtgattggcgcaggagaatttggagaagtatgcagcggtcgtctgaaactcccaggcaagagagacgtggcggtagccataaaaacgttgaaagttggctacacagaaaaacaaaggcgggacttcctgtgtgaagcaagcatcatgggacagtttgaccacccaaatgttgttcacttagaaggagttgttaccagggggaagccagtcatgatcgtaatagaatacatggaaaatggagccctagatgcatttcttcgaaaacacgatggacagtttaccgtcattcagcttgtgggcatgctgagaggaatcgccgccggaatgagatatttggccgatatgggctacgttcacagggacctagcagctcgtaatatcctggtcaacagcaaccttgtttgcaaagtgtccgatttcggcctgtccagagtgattgaagatgacccagaagctgtctatacaacgaccggtggaaaaattccggtccggtggacagcacctgaagccatccaatatcggaaatttacgtcagctagcgatgtgtggagttatggaatagttatgtgggaagtgatgtcatacggagaacgaccttattgggatatgtcaaatcaagatgttataaaagcaatcgaagaaggttatcgtttgccagcacccatggactgcccagctggccttcaccagttgatgctggattgttggcaaaaggatcgtggcgaaaggccaaagtttgaacagatagttggaattctggacaaaatgattcggaatccaaatagcctgaaaacacccctgggaacctgtagccgaccaatcagtcctcttctggatcaaaacactcctgatttcaccactttctgctctgttggagaatggctacaagccatcaaaatggaacggtataaagacaacttcacggcagctggctacaactctctggaatcagtggccaggatgaccattgaagatgtgatgagtttagggatcacattggtgggccatcaaaagaaaatcatgagtagcattcaaaccatgagagcacaaatgcttcatttacacggcactgggatccaggtgtga

SEQ ID NO: 60 - protein, 995 aa, Ornithorhynchus anatinus
MVVRPSWIIACYLWLLRLARPGEAQAAREVILLDSKSQQTELEWISSPSNGWEEISGLDENYTPIRTYQVCQVMEPNQNNWLRTSWIAKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVHSAEEEAENSPRMHCSAEGEWLVPIGKCICKAGYQQKGDTCEPCGRGFYKSSSQDLQCSRCPSHSFSDKEGSSRCDCEDGYYRALADPPYVACTRPPSAPQNLIFNINQTTVSLEWNPPADNGGRNDVTYRVLCKRCSWEQGECVPCGSNVGYLPQQSGLADNFVTVTDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSVSINNLKPGTVYVFQIRAFTAAGYGNYSPRLDVATLEEATGKMFEATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEYMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKDRGERPKFEQIVGILDKMIRNPNSLKTPLGTCSRPISPLLDQNTPDFTTFCSVGEWLQAIKMERYKDNFTAAGYNSLESVARMTIEDVMSLGITLVGHQKKIMSSIQTMRAQMLHLHGTGIQV

SEQ ID NO: 61 - DNA, 1404 bp, Mus musculus
  CDS (1)..(1401)
atgacagagatacctgcacctttgtcctacttccagaatgcccagatgtctgaggacagccactccagcagcgccatccggagccagaatgacagccaagaacggcagcagcagcatgacaggcagagacttgacaaccctgagccaatatctaatgggcggccccagagtaactcaagacaggtggtggaacaagatgaggaggaagacgaagagctgacattgaaatatggagccaagcatgtcatcatgctctttgtccccgtgaccctctgcatggtcgtcgtcgtggccaccatcaaatcagtcagcttctatacccggaaggacggtcagctaatctacaccccattcacagaagacactgagactgtaggccaaagagccctgcactcgatcctgaatgcggccatcatgatcagtgtcattgtcattatgaccatcctcctggtggtcctgtataaatacaggtgctacaaggtcatccacgcctggcttattatttcatctctgttgttgctgttctttttttcgttcatttacttaggggaagtatttaagacctacaatgtcgccgtggactacgttacagtagcactcctaatctggaattttggtgtggtcgggatgattgccatccactggaaaggcccccttcgactgcagcaggcgtatctcattatgatcagtgccctcatggccctggtatttatcaagtacctccccgaatggaccgcatggctcatcttggctgtgatttcagtatatgatttggtggctgttttatgtcccaaaggcccacttcgtatgctggttgaaacagctcaggaaagaaatgagactctctttccagctcttatctattcctcaacaatggtgtggttggtgaatatggctgaaggagacccagaagcccaaaggagggtacccaagaaccccaagtataacacacaaagagcggagagagagacacaggacagtggttctgggaacgatgatggtggcttcagtgaggagtgggaggcccaaagagacagtcacctggggcctcatcgctccactcccgagtcaagagctgctgtccaggaactttctgggagcattctaacgagtgaagacccggaggaaagaggagtaaaacttggactgggagatttcattttctacagtgttctggttggtaaggcctcagcaaccgccagtggagactggaacacaaccatagcctgctttgtagccatactgatcggcctgtgccttacattactcctgctcgccattttcaagaaagcgttgccagccctccccatctccatcaccttcgggctcgtgttctacttcgccacggattaccttgtgcagcccttcatggaccaacttgcattccatcagttttatatctag

SEQ ID NO: 62 - protein, 467 aa, Mus musculus
MTEIPAPLSYFQNAQMSEDSHSSSAIRSQNDSQERQQQHDRQRLDNPEPISNGRPQSNSRQVVEQDEEEDEELTLKYGAKHVIMLFVPVTLCMVVVVATIKSVSFYTRKDGQLIYTPFTEDTETVGQRALHSILNAAIMISVIVIMTILLVVLYKYRCYKVIHAWLIISSLLLLFFFSFIYLGEVFKTYNVAVDYVTVALLIWNFGVVGMIAIHWKGPLRLQQAYLIMISALMALVFIKYLPEWTAWLILAVISVYDLVAVLCPKGPLRMLVETAQERNETLFPALIYSSTMVWLVNMAEGDPEAQRRVPKNPKYNTQRAERETQDSGSGNDDGGFSEEWEAQRDSHLGPHRSTPESRAAVQELSGSILTSEDPEERGVKLGLGDFIFYSVLVGKASATASGDWNTTIACFVAILIGLCLTLLLLAIFKKALPALPISITFGLVFYFATDYLVQPFMDQLAFHQFYI

SEQ ID NO: 63 - DNA, 1407 bp, Rattus norvegicus
  CDS (1)..(1404)
atgacagagatacctgcacctttgtcctacttccagaatgcacagatgtctgaggacagccactccagcagcgtccgtagccagaatgacaatcaagaacggcagcagcatcatgacagacagagacttgacaaccctgagtcgatatctaatggccgaccccagagtaactttaccaggcaggtgatagagcaagatgaggaggaagacgaagagctgacattgaaatatggagccaagcacgtcatcatgctctttgttcctgtgaccctctgcatggtcgttgtggtggccactatcaagtcagtcagcttctacacccggaaggatgggcagctaatctataccccattcacagaagacaccgagactgtaggccagagagccctgcactcgatcttgaatgccgccatcatgatcagtgtcatcgtcgttatgaccatcctcctggtggtcctgtataagtacaggtgctacaaggtcatccatgcctggcttattgtttcatctctgttgttgctgttctttttttcattcatttacttaggggaagtattcaagacctacaatgtcgccgtggactatattacggttgcactcctgatctggaattttggtgtggtcgggatgattgccattcactggaaaggcccactccgactgcagcaggcgtatctcattatgatcagtgccctcatgtccctggtatttatcaagtacctccctgaatggaccgcatggctcatcttggctgtgatttcagtatatgatttggtggctgttctgtgccccaaaggtccacttcgtatgctggtcgaaacagctcaggaaagaaatgagactctctttccagctcttatctattcctcaaccatggtgtggttggtgaatatggctgaaggagacccagaagcccaaaggagggtacccaaaaaccccaagtatagcacacaaggaacagagagggaagagacacaggacactggcactgggagcgatgatggtggcttcagtgaggagtgggaggcccaaagagacagtcacctggggcctcatcgctccactcctgagtcaagagctgctgtccaggaactttctgggagcatcctcactagtgaagacccggaggaaagaggagtaaggcttgggctgggagatttcattttctacagtgttctggttggtaaggcctcagcgaccgccagtggggactggaacacaaccatagcctgctttgtagccatattgatcggcctgtgccttacgttactcctgctcgccattttcaagaaagcgttgccggcccttcccatctccatcaccttcgggctcattttctactttgccacggattatctcgtgcagcccttcatggaccaacttgcattccatcaattttatatctag

SEQ ID NO: 64 - protein, 468 aa, Rattus norvegicus
MTEIPAPLSYFQNAQMSEDSHSSSVRSQNDNQERQQHHDRQRLDNPESISNGRPQSNFTRQVIEQDEEEDEELTLKYGAKHVIMLFVPVTLCMVVVVATIKSVSFYTRKDGQLIYTPFTEDTETVGQRALHSILNAAIMISVIVVMTILLVVLYKYRCYKVIHAWLIVSSLLLLFFFSFIYLGEVFKTYNVAVDYITVALLIWNFGVVGMIAIHWKGPLRLQQAYLIMISALMSLVFIKYLPEWTAWLILAVISVYDLVAVLCPKGPLRMLVETAQERNETLFPALIYSSTMVWLVNMAEGDPEAQRRVPKNPKYSTQGTEREETQDTGTGSDDGGFSEEWEAQRDSHLGPHRSTPESRAAVQELSGSILTSEDPEERGVRLGLGDFIFYSVLVGKASATASGDWNTTIACFVAILIGLCLTLLLLAIFKKALPALPISITFGLIFYFATDYLVQPFMDQLAFHQFYI

SEQ ID NO: 65 - DNA, 1404 bp, Homo sapiens
  CDS (1)..(1401)
atgacagagttacctgcaccgttgtcctacttccagaatgcacagatgtctgaggacaaccacctgagcaatactgtacgtagccagaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataaggtcatccatgcctggcttattatatcatctctattgttgctgttctttttttcattcatttacttgggggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatgatttagtggctgttttgtgtccgaaaggtccacttcgtatgctggttgaaacagctcaggagagaaatgaaacgctttttccagctctcatttactcctcaacaatggtgtggttggtgaatatggcagaaggagacccggaagctcaaaggagagtatccaaaaattccaagtataatgcagaaagcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaaggggagtaaaacttggattgggagatttcattttctacagtgttctggttggtaaagcctcagcaacagccagtggagactggaacacaaccatagcctgtttcgtagccatattaattggtttgtgccttacattattactccttgccattttcaagaaagcattgccagctcttccaatctccatcacctttgggcttgttttctactttgccacagattatcttgtacagccttttatggaccaattagcattccatcaattttatatctag

SEQ ID NO: 66 - protein, 467 aa, Homo sapiens
MTELPAPLSYFQNAQMSEDNHLSNTVRSQNDNRERQEHNDRRSLGHPEPLSNGRPQGNSRQVVEQDEEEDEELTLKYGAKHVIMLFVPVTLCMVVVVATIKSVSFYTRKDGQLIYTPFTEDTETVGQRALHSILNAAIMISVIVVMTILLVVLYKYRCYKVIHAWLIISSLLLLFFFSFIYLGEVFKTYNVAVDYITVALLIWNFGVVGMISIHWKGPLRLQQAYLIMISALMALVFIKYLPEWTAWLILAVISVYDLVAVLCPKGPLRMLVETAQERNETLFPALIYSSTMVWLVNMAEGDPEAQRRVSKNSKYNAESTERESQDTVAENDDGGFSEEWEAQRDSHLGPHRSTPESRAAVQELSSSILAGEDPEERGVKLGLGDFIFYSVLVGKASATASGDWNTTIACFVAILIGLCLTLLLLAIFKKALPALPISITFGLVFYFATDYLVQPFMDQLAFHQFYI

SEQ ID NO: 67 - DNA, 1347 bp, Mus musculus
  CDS (1)..(1344)
atgctcgcattcatggcctctgacagcgaggaagaggtgtgtgatgagcggacgtccttgatgtcagccgagagccccacatctcgctcctgccaggaaggcaggccaggcccggaggatggagagagcactgcccagtggaggactcaggagagcgaagaagactgtgaagaggacccggaccgctacgcatgcagtggggctcctgggcgaccgtcgggcctggaggaagagctgaccctcaagtatggggcgaaacgtgtgatcatgctattcgtgcctgtcacgctgtgtatgatcgtggtggtggccactatcaagtctgtgcgtttctacactgagaagaacgggcagctcatctacacgcccttcacggaggacacgccctcggtgggccagcggctcctcaactccgtgcttaacaccctcatcatgatcagcgtcatcgtagtcatgaccatcttcctcgtggtactctacaagtatcgatgctacaagttcatccatggctggctgatcatgtcctccctgatgctcctcttcttgttcacctacatctacctcggggaagtgctcaagacctacaatgtggccatggactatcccacactcttcctggctgtctggaacttcggggcagtgggcatggtgtgcatccactggaaggggcctctagcgctgcagcaggcttaccttattgtgatcagcgcactcatggccctggtgttcatcaagtacctgccggagtggtctgcctgggtcatcttgggtgccatctctgtgtacgatctcgtggccgtgctgtgccccaaagggccactgaggatgctggtggaaactgcccaggagagaaatgagcccatatttcctgccctgatatactcatctgccatggtgtggacggtgggcatggcaaagctggacccctcctctcaaggagcgctgcagctcccctatgacccagagatggaagaagactcctacgacagttttggagaaccctcataccctgaagccttcgaagcccccctgcctggctacccaggggaggagctggaggaggaggaggaaaggggcgtgaagctcggcctgggagacttcatcttctacagcgtcctggtgggcaaggctgcagccactggcaacggagactggaacactacgctggcctgttttatcgccatcctcattggcttgtgtctcaccctcctgctgcttgctgtgttcaagaaggctctgcccgccctccccatctccatcacctttggactcatcttctacttctccacagacaacctggtgcgccctttcatggacactctggcctcccaccagctctacatctga

SEQ ID NO: 68 - protein, 448 aa, Mus musculus
MLAFMASDSEEEVCDERTSLMSAESPTSRSCQEGRPGPEDGESTAQWRTQESEEDCEEDPDRYACSGAPGRPSGLEEELTLKYGAKRVIMLFVPVTLCMIVVVATIKSVRFYTEKNGQLIYTPFTEDTPSVGQRLLNSVLNTLIMISVIVVMTIFLVVLYKYRCYKFIHGWLIMSSLMLLFLFTYIYLGEVLKTYNVAMDYPTLFLAVWNFGAVGMVCIHWKGPLALQQAYLIVISALMALVFIKYLPEWSAWVILGAISVYDLVAVLCPKGPLRMLVETAQERNEPIFPALIYSSAMVWTVGMAKLDPSSQGALQLPYDPEMEEDSYDSFGEPSYPEAFEAPLPGYPGEELEEEEERGVKLGLGDFIFYSVLVGKAAATGNGDWNTTLACFIAILIGLCLTLLLLAVFKKALPALPISITFGLIFYFSTDNLVRPFMDTLASHQLYI

SEQ ID NO: 69 - DNA, 1347 bp, Rattus norvegicus
  CDS (1)..(1344)
atgctcacattcatggcctctgatagcgaggaagaggtgtgcgatgagcggacgtccttgatgtcagccgagagccctacatcacgttcctgccaggacagcaggccaggcccagaggatggagagaacactgcccagtggaggagccaggagaacgaggacgactgtgaggaggacccggaccactatgcctgcagtggggttcctgggcgaccatcgggcctggaggaggagctgaccctcaagtatggggcgaagcacgtgatcatgctgttcgtgcctgtcacgctgtgcatgattgtggtggtggccaccatcaagtccgtgcgtttctacacggagaagaacgggcagctcatctacacgcccttcaccgaggacacaccctctgtgggccagcggctcctcaactccgtgctgaacactctgatcatgatcagcgtcattgtggtcatgactatcttcctagtggtactctacaaatatcgctgttacaagttcatccatggctggctgatcatgtcctccctgatgctcctcttcttgttcacctacatctacctcggggaagtgttcaagacctacaatgtggccatggactaccccacactgttcctggctgtctggaacttcggggcagtgggcatggtgtgcatccactggaagggtcccctggtgctccagcaggcttacctcattgtgatcagcgcactcatggccctggtgttcatcaagtacctgccggagtggtccgcttgggtcatcttgggcgccatctctgtgtacgatctcgtggctgtgctgtgccccaaagggccactgaggatgctggtggaaactgcccaggaaagaaacgagcccatatttcctgccctcatatactcatctgccatggtgtggacggtaggcatggcgaagctggacccctcctctcagggagcactgcagctcccttacgatccagagatggaagaagactcctatgacagttttggggaaccctcataccctgaagccttcgaagctccccagcctggctacccaggggaagagccggaggaggaggaggaaaggggtgtaaagcttggtctgggagacttcatcttctacagcgttctggtgggcaaggcagcagccacaggcaacggagactggagcacgacgctggcctgctttatcgccatcctcattggcttgtgtctcaccctcctgctgctcgccgtgttcaagaaggccctgcccgccctccccatctccatcaccttcgggctcatcttttacttctccacagacaacctggtgcgtcctttcatggacacgttggcctcccaccagctctacatctga

SEQ ID NO: 70 - protein, 448 aa, Rattus norvegicus
MLTFMASDSEEEVCDERTSLMSAESPTSRSCQDSRPGPEDGENTAQWRSQENEDDCEEDPDHYACSGVPGRPSGLEEELTLKYGAKHVIMLFVPVTLCMIVVVATIKSVRFYTEKNGQLIYTPFTEDTPSVGQRLLNSVLNTLIMISVIVVMTIFLVVLYKYRCYKFIHGWLIMSSLMLLFLFTYIYLGEVFKTYNVAMDYPTLFLAVWNFGAVGMVCIHWKGPLVLQQAYLIVISALMALVFIKYLPEWSAWVILGAISVYDLVAVLCPKGPLRMLVETAQERNEPIFPALIYSSAMVWTVGMAKLDPSSQGALQLPYDPEMEEDSYDSFGEPSYPEAFEAPQPGYPGEEPEEEEERGVKLGLGDFIFYSVLVGKAAATGNGDWSTTLACFIAILIGLCLTLLLLAVFKKALPALPISITFGLIFYFSTDNLVRPFMDTLASHQLYI

SEQ ID NO: 71 - DNA, 1347 bp, Homo sapiens
  CDS (1)..(1344)
atgctcacattcatggcctctgacagcgaggaagaagtgtgtgatgagcggacgtccctaatgtcggctgagagccccacgccgcgctcctgccaggagggcaggcagggcccagaggatggagagaacactgcccagtggagaagccaggagaacgaggaggacggtgaggaggaccctgaccgctatgtctgtagtggggttcccgggcggccgccaggcctggaggaagagctgaccctcaaatacggagcgaagcacgtgatcatgctgtttgtgcctgtcactctgtgcatgatcgtggtggtagccaccatcaagtctgtgcgcttctacacagagaagaatggacagctcatctacacgccattcactgaggacacaccctcggtgggccagcgcctcctcaactccgtgctgaacaccctcatcatgatcagcgtcatcgtggttatgaccatcttcttggtggtgctctacaagtaccgctgctacaagttcatccatggctggttgatcatgtcttcactgatgctgctgttcctcttcacctatatctaccttggggaagtgctcaagacctacaatgtggccatggactaccccaccctcttgctgactgtctggaacttcggggcagtgggcatggtgtgcatccactggaagggccctctggtgctgcagcaggcctacctcatcatgatcagtgcgctcatggccctagtgttcatcaagtacctcccagagtggtccgcgtgggtcatcctgggcgccatctctgtgtatgatctcgtggctgtgctgtgtcccaaagggcctctgagaatgctggtagaaactgcccaggagagaaatgagcccatattccctgccctgatatactcatctgccatggtgtggacggttggcatggcgaagctggacccctcctctcagggtgccctccagctcccctacgacccggagatggaagaagactcctatgacagttttggggagccttcataccccgaagtctttgagcctcccttgactggctacccaggggaggagctggaggaagaggaggaaaggggcgtgaagcttggcctcggggacttcatcttctacagtgtgctggtgggcaaggcggctgccacgggcagcggggactggaataccacgctggcctgcttcgtggccatcctcattggcttgtgtctgaccctcctgctgcttgctgtgttcaagaaggcgctgcccgccctccccatctccatcacgttcgggctcatcttttacttctccacggacaacctggtgcggccgttcatggacaccctggcctcccatcagctctacatctga

SEQ ID NO: 72 - protein, 448 aa, Homo sapiens
MLTFMASDSEEEVCDERTSLMSAESPTPRSCQEGRQGPEDGENTAQWRSQENEEDGEEDPDRYVCSGVPGRPPGLEEELTLKYGAKHVIMLFVPVTLCMIVVVATIKSVRFYTEKNGQLIYTPFTEDTPSVGQRLLNSVLNTLIMISVIVVMTIFLVVLYKYRCYKFIHGWLIMSSLMLLFLFTYIYLGEVLKTYNVAMDYPTLLLTVWNFGAVGMVCIHWKGPLVLQQAYLIMISALMALVFIKYLPEWSAWVILGAISVYDLVAVLCPKGPLRMLVETAQERNEPIFPALIYSSAMVWTVGMAKLDPSSQGALQLPYDPEMEEDSYDSFGEPSYPEVFEPPLTGYPGEELEEEEERGVKLGLGDFIFYSVLVGKAAATGSGDWNTTLACFVAILIGLCLTLLLLAVFKKALPALPISITFGLIFYFSTDNLVRPFMDTLASHQLYI

SEQ ID NO: 73 - DNA, 2127 bp, Mus musculus
  CDS (1)..(2124)
atggctacgactaggggcggctctgggcctgacccaggaagtcggggtcttcttcttctgtctttttccgtggtactggcaggattgtgtgggggaaactcagtggagaggaaaatctacattcccttaaataaaacagctccttgtgtccgcctgctcaacgccactcatcagattggctgccagtcttcaattagtggggatacaggggttatccacgtagtggagaaagaagaagacctgaagtgggtgttgaccgatggccccaaccccccttacatggttctgctggagggcaagctcttcaccagagatgtaatggagaagctgaagggaacaaccagtagaatcgctggtcttgccgtgactctagccaagcccaactcaacttcaagcttctctcctagtgtgcagtgcccaaatgatgggtttggtatttactccaactcctacgggccagagtttgctcactgcaagaaaacactgtggaatgaactgggcaacggcttggcttatgaagactttagtttccccatctttcttcttgaagatgagaacgaaaccaaggtcatcaagcagtgctatcaagatcacaacctgggtcagaatggctctgcaccaagcttcccattgtgtgctatgcagctcttctcacacatgcacgccgtcatcagcactgccacctgcatgcggcgcagcttcatccagagcaccttcagcatcaacccagaaatcgtctgtgaccccttatctgactacaacgtatggagcatgcttaagcctataaatacatctgtgggactagaacctgacgtcagggttgtggttgcggccacacggctggatagccggtcctttttctggaatgtggccccaggggctgaaagtgctgtagcctcctttgtcactcagctggctgcagctgaagctttgcacaaggcacctgatgtgaccactctatcccgaaatgtgatgtttgtcttcttccagggggaaacttttgactacattggcagctcacggatggtctatgatatggagaacggcaagtttcccgtgcggctcgagaacatcgactccttcgtggagctgggacaggtggccctaagaacttcactagatctctggatgcacacagatcccatgtctcagaaaaatgagtctgtgaaaaaccaggtggaggatcttctggccactctggagaagagcggtgctggtgtccctgaagttgtcctgaggagactggcccagtcccaggcccttccaccttcatctctacaacgatttcttcgggctcgaaacatctctggcgtggtcctggctgaccactctggctccttccacaatcggtattaccagagcatttatgacacggctgagaacattaatgtgacctatcctgagtggcagagcccagaagaggacctcaactttgtgacagacactgccaaggcactggcgaatgtggccacagtgctggcgcgtgcactgtatgagcttgcaggaggaaccaacttcagcagctccatccaggctgatccccagacagttacacgtctgctctatgggttcctggttaaagctaacaactcatggtttcagtcgatcctgaaacatgacctaaggtcctatttggatgacaggcctcttcaacactacatcgccgtctccagccctaccaacacgacttacgttgtgcagtacgccttggcaaacctgactggcaaggcgaccaacctcacccgagagcagtgccaggatccaagtaaagtcccaaatgagagcaaggatttatatgaatactcgtgggtacaaggcccttggaattccaacaggacagagaggctcccacagtgtgtgcgctccacagtgcgactggccagggccttgtcccctgcctttgaactgagtcagtggagctccacagaatactctacgtgggcggagagccgctggaaagacatccaagctcggatattcctaattgccagcaaagagcttgagttcatcacgctgatcgtgggcttcagcatccttatcttctctctcatcgtcacctactgcatcaatgccaaagccgacgtcctttttgttgctccccgagagccaggagctgtgtcttactga

SEQ ID NO: 74 - protein, 708 aa, Mus musculus
MATTRGGSGPDPGSRGLLLLSFSVVLAGLCGGNSVERKIYIPLNKTAPCVRLLNATHQIGCQSSISGDTGVIHVVEKEEDLKWVLTDGPNPPYMVLLEGKLFTRDVMEKLKGTTSRIAGLAVTLAKPNSTSSFSPSVQCPNDGFGIYSNSYGPEFAHCKKTLWNELGNGLAYEDFSFPIFLLEDENETKVIKQCYQDHNLGQNGSAPSFPLCAMQLFSHMHAVISTATCMRRSFIQSTFSINPEIVCDPLSDYNVWSMLKPINTSVGLEPDVRVVVAATRLDSRSFFWNVAPGAESAVASFVTQLAAAEALHKAPDVTTLSRNVMFVFFQGETFDYIGSSRMVYDMENGKFPVRLENIDSFVELGQVALRTSLDLWMHTDPMSQKNESVKNQVEDLLATLEKSGAGVPEVVLRRLAQSQALPPSSLQRFLRARNISGVVLADHSGSFHNRYYQSIYDTAENINVTYPEWQSPEEDLNFVTDTAKALANVATVLARALYELAGGTNFSSSIQADPQTVTRLLYGFLVKANNSWFQSILKHDLRSYLDDRPLQHYIAVSSPTNTTYVVQYALANLTGKATNLTREQCQDPSKVPNESKDLYEYSWVQGPWNSNRTERLPQCVRSTVRLARALSPAFELSQWSSTEYSTWAESRWKDIQARIFLIASKELEFITLIVGFSILIFSLIVTYCINAKADVLFVAPREPGAVSY

SEQ ID NO: 75 - DNA, 2127 bp, Rattus norvegicus
  CDS (1)..(2124)
atggctacggctaggggcggctctgggcctgacccaggaagtcggggtctccttcttctgtctttttccgtggtactagcaggattgtgtgggggaaactcagtggagaggaagatctacattcccttaaataaaacagctccttgtgtccgcctgctcaatgccactcatcagattggctgccagtcttcaattagtggggatacaggggttatccacgtagtggagaaagaagacgacctgaaatgggtattgacggatggccccaaccccccttacatggttctgctggagggcaagctctttaccagagatataatggaaaagctgaagggggaaaccagtagaatcgctggtcttgccgtgactctagccaagcccaattcaacgtcaagcttctctcctagcgtgcagtgcccaaatgatgggtttggtatttactccaactcctatgggccagagtttgctcactgcaaaaaaacattgtggaatgaactgggcaatggcttggcttatgacgacttcagtttccccatctttcttcttgaagatgagaacgaaaccaaggtcatcaagcagtgctatcaagatcacaacctgggtcagaatggctctgcaccgagcttcccactgtgtgctatgcagctcttctcacacatgcacgccgtcatcagcaccgccacctgcatgcgacgcagcttcatccagagcaccttcagcatcaacccagaaatcgtctgtgaccccttatccgactacaacgtatggagcatgcttaagcctataaatacgtctgggggattagaacctgatgtcagggttgtggttgcagccacacggctggatagccggtccttcttctggaatgtggccccaggggcagaaagtgccgttgcctcctttgtcactcagctggccgcagctgaagctttgcacaaggcacctgatgtgaccaccctaccccgaaatgtgatgtttgtcttcttccagggggaaacttttgactacattggcagctcaaggatggtctatgacatggagaacggcaagtttcctgtgcggctagagaacattgactcctttgtggagctggggcaggtggccctaaggacgtcactagaactctggatgcacacagatcctatgtctcagaaaaatgaatctgtgaagaaccaggtggaggatcttctggtcactctggagcagagtggtgctgatacccctcaagttgtcctgagcagactagtccagtcccaggcccttccaccatcatctctacaacgatttcttcgggctcgaaacatctctggtgtggtcttggctgaccactctggttccttccacaatcggtattaccagagcatttatgacactgctgagaacattaacgtgacctatcctgagtcgcagagcccagaagaggacctcaactttgtaacagacactgccaaggcactggcagatgttgccacagtgctggcacgagctttgtacaagcttgcaggaggaaccaacttcaacaactccattcaggctgatccccagacagttacacgtctgctctatgggttcctggtcagagctaacaactcatggtttcagtctatcctcagacatgatctgaggtcctatttggatgatgggcctcttcaacactacatcgctgtctccagccctaccaacacgacttacgttgtgcagtatgccttggcaaacctgactggcaaggtgaccaacctcacccaagagcagtgccaggatccaagtaaagtcccaaatgaaagcaaggatttgtatgaatactcgtgggtacaaggcccttggaattccaacaagacagagcggctcccacggtgtgtgcgctccacagtacgactggctagggccttgtcccccgcctttgagctgagtcagtggagctccacagaatactctacgtgggccgagagccgctggaaagatatccaagctcggatattcctcattgccagcaaagaacttgagttcatcacgctgatcgtgggcttcagcatcctcgtcttttctctcatcgtcacttattgtatcaacgccaaggccgatgtccttttcgttgctccccgagagccaggagctgtgtcttactga

SEQ ID NO: 76 - protein, 708 aa, Rattus norvegicus
MATARGGSGPDPGSRGLLLLSFSVVLAGLCGGNSVERKIYIPLNKTAPCVRLLNATHQIGCQSSISGDTGVIHVVEKEDDLKWVLTDGPNPPYMVLLEGKLFTRDIMEKLKGETSRIAGLAVTLAKPNSTSSFSPSVQCPNDGFGIYSNSYGPEFAHCKKTLWNELGNGLAYDDFSFPIFLLEDENETKVIKQCYQDHNLGQNGSAPSFPLCAMQLFSHMHAVISTATCMRRSFIQSTFSINPEIVCDPLSDYNVWSMLKPINTSGGLEPDVRVVVAATRLDSRSFFWNVAPGAESAVASFVTQLAAAEALHKAPDVTTLPRNVMFVFFQGETFDYIGSSRMVYDMENGKFPVRLENIDSFVELGQVALRTSLELWMHTDPMSQKNESVKNQVEDLLVTLEQSGADTPQVVLSRLVQSQALPPSSLQRFLRARNISGVVLADHSGSFHNRYYQSIYDTAENINVTYPESQSPEEDLNFVTDTAKALADVATVLARALYKLAGGTNFNNSIQADPQTVTRLLYGFLVRANNSWFQSILRHDLRSYLDDGPLQHYIAVSSPTNTTYVVQYALANLTGKVTNLTQEQCQDPSKVPNESKDLYEYSWVQGPWNSNKTERLPRCVRSTVRLARALSPAFELSQWSSTEYSTWAESRWKDIQARIFLIASKELEFITLIVGFSILVFSLIVTYCINAKADVLFVAPREPGAVSY

SEQ ID NO: 77 - DNA, 2130 bp, Homo sapiens
  CDS (1)..(2127)
atggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactga

SEQ ID NO: 78 - protein, 709 aa, Homo sapiens
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLYEYSWVQGPLHSNETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 79 - DNA, 744 bp, Mus musculus
  CDS (1)..(741)
atgggggctgctgtgtttttcggatgcaccttcgtcgcgttcggcccagccttctcccttttcctgatcactgtagctggagacccacttcgggttatcatcctggtggcgggagcctttttctggctggtctccctgctcttggcttctgtggtctggttcatcttggtccatgtgacagaccgatcagatgcacggctccagtatggcctcctgatttttggtgctgctgtctctgtccttctacaggaagtgttccgttttgcttactacaagctccttaagaaggcagatgagggcttagcatcactgagtgaggacggaagatcacccatctccatccgacagatggcctatgtttctggtctgtccttcggtatcatcagtggtgtcttctctgttatcaatattttggctgatgcacttgggccaggtgtggttgggatccatggagactcaccctattacttcctgacttcagcctttctgacagcagccattatcctgctccacaccttttggggagttgtgttctttgatgcctgtgagaggagacggtactgggctttgggcctggtagttgggagtcaccttctgacatcgggactgacattcctgaacccctggtatgaggctagcctgctgcccatctatgcagtcaccgtttccatggggctctgggcgttcatcacagccggaggctccctccgaagtatccagcgcagcctttcgtgtaaggactga

SEQ ID NO: 80 - protein, 247 aa, Mus musculus
MGAAVFFGCTFVAFGPAFSLFLITVAGDPLRVIILVAGAFFWLVSLLLASVVWFILVHVTDRSDARLQYGLLIFGAAVSVLLQEVFRFAYYKLLKKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLSCKD

SEQ ID NO: 81 - DNA, 744 bp, Rattus norvegicus
  CDS (1)..(741)
atgggggctgctgtgtttttcggatgcaccttcgtcgcgttcggcccagccttcgcccttttcctgattactgtagccggagaccctcttcgggttatcatcctggtggcgggagcctttttctggctggtttccctgctcttggcctctgtggtctggttcatcttggtccatgtgacagaccgatcagatgcacggctccagtatggcctcctgatttttggtgctgctgtctctgtccttctacaggaagtgttccgttttgcctactacaagctccttaagaaggcagatgagggcttagcatcactaagtgaggacggaagatcgcccatctccatccgacagatggcctatgtttctggtctgtccttcggtatcatcagtggtgtcttctctgttatcaatattttggctgatgcacttgggccaggtgtggttgggatccatggagactcaccctattacttcctgacttcagcttttctgacagcagccattatcctgctccataccttttggggagttgtgttctttgatgcctgtgagaggagacggtactgggctttgggcctggtagttgggagtcaccttctgacttcaggactgacattcctgaacccctggtatgaggccagcctgctgcccatctatgcagtcaccgtttccatggggctctgggcattcgtcacagccggaggctccctccggagtatccagcgcagcctttcgtgtaaggactga

SEQ ID NO: 82 - protein, 247 aa, Rattus norvegicus
MGAAVFFGCTFVAFGPAFALFLITVAGDPLRVIILVAGAFFWLVSLLLASVVWFILVHVTDRSDARLQYGLLIFGAAVSVLLQEVFRFAYYKLLKKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFVTAGGSLRSIQRSLSCKD

SEQ ID NO: 83 - DNA, 744 bp, Homo sapiens
  CDS (1)..(741)
atgggggctgcggtgtttttcggctgcactttcgtcgcgttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcagcctcttgtgtaaggactga

SEQ ID NO: 84 - protein, 247 aa, Homo sapiens
MGAAVFFGCTFVAFGPAFALFLITVAGDPLRVIILVAGAFFWLVSLLLASVVWFILVHVTDRSDARLQYGLLIFGAAVSVLLQEVFRFAYYKLLKKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLLCKD

SEQ ID NO: 85 - DNA, 306 bp, Mus musculus
  CDS (1)..(303)
atgaacttggagcgggtatccaatgaggagaagttgaacctgtgccggaagtactatcttggtggatttgcgttcctgccttttctttggttagtcaacattttctggttcttcagagaggcgttcctcgccccagcctacacagagcagagccaaatcaaaggctatgtttggcgctcagctgtgggcttcctcttctgggtgatcattctcgccacctggatcaccatcttccagatctaccggccccgctggggcgctcttggggactacctctccttcaccattcccctgggcactccctaa

SEQ ID NO: 86 - protein, 101 aa, Mus musculus
MNLERVSNEEKLNLCRKYYLGGFAFLPFLWLVNIFWFFREAFLAPAYTEQSQIKGYVWRSAVGFLFWVIILATWITIFQIYRPRWGALGDYLSFTIPLGTP

SEQ ID NO: 87 - DNA, 306 bp, Rattus norvegicus
  CDS (1)..(303)
atgaacttagagcgggtgtccaatgaggagaagttgaacctgtgccggaagtactatcttggtggatttgcatttctgccttttctttggttggtcaacattttctggttcttcaaagaggccttcttcgctccagcctacacagagcagagccaaatcaaaggctatgtttggcgctcagctgtgggcttcctcttctgggtgattgttctcaccacctggatcaccatcttccagatctaccggccccgctggggtgctcttggggactacctctccttcaccattcccctgggcactccctga

SEQ ID NO: 88 - protein, 101 aa, Rattus norvegicus
MNLERVSNEEKLNLCRKYYLGGFAFLPFLWLVNIFWFFKEAFFAPAYTEQSQIKGYVWRSAVGFLFWVIVLTTWITIFQIYRPRWGALGDYLSFTIPLGTP

SEQ ID NO: 89 - DNA, 306 bp, Homo sapiens
  CDS (1)..(303)
atgaacctggagcgagtgtccaatgaggagaaattgaacctgtgccggaagtactacctgggggggtttgctttcctgccttttctctggttggtcaacatcttctggttcttccgagaggccttccttgtcccagcctacacagaacagagccaaatcaaaggctatgtctggcgctcagctgtgggcttcctcttctgggtgatagtgctcacctcctggatcaccatcttccagatctaccggccccgctggggtgcccttggggactacctctccttcaccatacccctgggcaccccctga

SEQ ID NO: 90 - protein, 101 aa, Homo sapiens
MNLERVSNEEKLNLCRKYYLGGFAFLPFLWLVNIFWFFREAFLVPAYTEQSQIKGYVWRSAVGFLFWVIVLTSWITIFQIYRPRWGALGDYLSFTIPLGTP

SEQ ID NO: 91 - DNA, 38 bp, Artificial sequence
  Synthetic DNA
gaggtcgacgccaccatggttgttcaaactcggtaccc

SEQ ID NO: 92 - DNA, 24 bp, Artificial sequence
  Synthetic DNA
acctgaagcttcctctagtgttgc

SEQ ID NO: 93 - DNA, 23 bp, Artificial sequence
  Synthetic DNA
gccggctatggaaattacagccc

SEQ ID NO: 94 - DNA, 35 bp, Artificial sequence
  Synthetic DNA
gaggcggccgccacttggatgccggttccgtgtaa

SEQ ID NO: 95 - DNA, 12 bp, Rattus norvegicus
ttaaatttccag

SEQ ID NO: 96 - protein, 5 aa, Rattus norvegicus
FKFPG

The invention claimed is:

1. A method of screening for candidate compounds which affect cleavage of EphA7 by γ-secretase, comprising the following steps:
   (i) contacting a first biological composition containing γ-secretase or a biologically active fragment thereof with a second biological composition that contains EphA7 in the presence of a candidate compound, and separately contacting said first biological composition with said second biological composition in the absence of the candidate compound, to allow EphA7 to be cleaved;
   (ii) measuring the cleavage of the EphA7 in the presence and absence of the candidate compound;
   (iii) selecting those candidate compounds which affect the cleavage of the EphA7 by γ-secretase; and
   (iv) identifying the candidate compounds selected in step (iii) as compounds which affect the processing of EphA7 by γ-secretase.

2. The method of claim 1, further comprising evaluating a candidate compound as an inhibitor of the EphA7 cleavage activity of γ-secretase when uncleaved EphA7 product is increased in the presence of said candidate compound, relative to uncleaved EphA7 product in the absence of said candidate compound, in the cleavage of EphA7 measured in step (ii).

3. The method of claim 1, further comprising evaluating a candidate compound as an accelerator of the EphA7 cleavage activity of γ-secretase when uncleaved EphA7 product is decreased in the presence of said candidate compound, relative to uncleaved EphA7 product in the absence of said candidate compound, in the cleavage of EphA7 measured in step (ii).

4. The method of claim 1, further comprising the step of evaluating a candidate compound as an accelerator of the EphA7 cleavage activity of γ-secretase when EphA7 cleavage product is increased in the presence of said candidate compound, relative to EphA7 cleavage product in the absence of said candidate compound, in the cleavage of EphA7 measured in step (ii).

5. The method of claim 1, further comprising the step of evaluating a candidate compound as an inhibitor of the EphA7 cleavage activity of γ-secretase when EphA7 cleavage product is decreased in the presence of said candidate compound, relative to EphA7 cleavage product in the absence of said candidate compound, in the cleavage of EphA7 measured in step (ii).

6. The method of claim 1, further comprising measuring the cleavage of APP or a polypeptide comprising an APP γ-secretase cleavage site.

7. The method of claim 1, further comprising measuring the cleavage of Notch or a polypeptide comprising a Notch γ-secretase cleavage site.

* * * * *